US008551751B2

(12) United States Patent
Emalfarb et al.

(10) Patent No.: US 8,551,751 B2
(45) Date of Patent: Oct. 8, 2013

(54) BX11 ENZYMES HAVING XYLOSIDASE ACTIVITY

(75) Inventors: Mark A. Emalfarb, Jupiter, FL (US); Alexander Vasilievich Gusakov, Moscow (RU); Peter J. Punt, Houten (NL); Jan Cornelis Verdoes, Bennekom (NL); Arkady Panteleimonovich Sinitsyn, Moscow (RU); Elena Vlasenko, Davis, CA (US); Sandra Wihelmina Agnes Hinz, Wageningen (NL); Mark Gosink, Wellington, FL (US); Zhijie Jiang, West Palm Beach, FL (US); Jacoba Van der Meij, Bennekom (NL)

(73) Assignee: Dyadic International, Inc., Jupiter, FL (US)

( * ) Notice: Subject to any disclaimer, the term of this patent is extended or adjusted under 35 U.S.C. 154(b) by 638 days.

(21) Appl. No.: 12/205,694

(22) Filed: Sep. 5, 2008

(65) Prior Publication Data
US 2009/0099079 A1    Apr. 16, 2009

Related U.S. Application Data

(60) Provisional application No. 60/970,876, filed on Sep. 7, 2007.

(51) Int. Cl.
| *C12N 9/00*  | (2006.01) |
| *C12N 9/02*  | (2006.01) |
| *C12N 1/20*  | (2006.01) |
| *C12N 15/00* | (2006.01) |
| *C07H 21/04* | (2006.01) |

(52) U.S. Cl.
USPC ..... 435/189; 435/183; 435/252.3; 435/320.1; 536/23.2

(58) Field of Classification Search
None
See application file for complete search history.

(56) References Cited

U.S. PATENT DOCUMENTS

| 2,974,001 A | 3/1961 | Windbichler et al. |
| 3,844,890 A | 10/1974 | Horikoshi et al. |
| 3,966,543 A | 6/1976 | Cayle et al. |
| 4,081,328 A | 3/1978 | Skinner et al. |
| 4,435,307 A | 3/1984 | Barbesgaard et al. |
| 4,443,355 A | 4/1984 | Murata et al. |
| 4,462,307 A | 7/1984 | Wells |
| 4,479,881 A | 10/1984 | Tai |
| 4,486,533 A | 12/1984 | Lambowitz |
| 4,610,800 A | 9/1986 | Durham et al. |
| 4,661,289 A | 4/1987 | Parslow et al. |
| 4,816,405 A | 3/1989 | Timberlake et al. |
| 4,832,864 A | 5/1989 | Olson |
| 4,885,249 A | 12/1989 | Buxton et al. |
| 4,912,056 A | 3/1990 | Olson |
| 4,935,349 A | 6/1990 | McKnight et al. |
| 4,940,838 A | 7/1990 | Schilperoort et al. |
| 5,006,126 A | 4/1991 | Olson et al. |
| 5,120,463 A | 6/1992 | Bjork et al. |
| 5,122,159 A | 6/1992 | Olson et al. |
| 5,198,345 A | 3/1993 | Gwynne et al. |
| 5,223,409 A | 6/1993 | Ladner et al. |
| 5,252,726 A | 10/1993 | Woldike |
| 5,290,474 A | 3/1994 | Clarkson et al. |
| 5,362,638 A | 11/1994 | Dahiya |
| 5,364,770 A | 11/1994 | Berka et al. |
| 5,436,158 A | 7/1995 | Takagi et al. |
| 5,457,046 A | 10/1995 | Woldike et al. |
| 5,464,763 A | 11/1995 | Schilperoort et al. |
| 5,503,991 A | 4/1996 | Gwynne et al. |
| 5,516,670 A | 5/1996 | Kuehnle et al. |
| 5,536,661 A | 7/1996 | Boel et al. |
| 5,565,332 A | 10/1996 | Hoogenboom et al. |
| 5,578,463 A | 11/1996 | Berka et al. |
| 5,602,004 A | 2/1997 | Jensen et al. |
| 5,604,129 A | 2/1997 | Jensen et al. |
| 5,605,793 A | 2/1997 | Stemmer |
| 5,627,052 A | 5/1997 | Schrader |
| 5,686,593 A | 11/1997 | Woldike et al. |
| 5,695,965 A | 12/1997 | Stuart et al. |

(Continued)

FOREIGN PATENT DOCUMENTS

| EP | 0239400 A2 | 9/1987 |
| EP | 0220016 B1 | 8/1991 |

(Continued)

OTHER PUBLICATIONS

Accession O74240. Published Nov. 1, 1998.*
Whisstock et al. Q Rev Biophys. Aug. 2003;36(3):307-40.*
Birren et al., Database UniProt:Q2GZ45, XP002594851, Mar. 21, 2006, Nucleotide Sequence, "Annotation of the *Chaetomium globosum* CBS 148.51 genome," (1 page).
U.S. Appl. No. 11/833,133, filed Aug. 2, 2007, Gusakov.
Armesilla et al., "CEL1: a novel cellulose binding protein secreted by *Agaricus bisporus* during growth on crystalline cellulose," FEMS Microbiology Letters 116 (1994) 293-300.
Bajpai, P., Bajpai, P.K Deinking with enzymes: a review. TAPPI Journal. 1998. 81(12), 111-117.

(Continued)

Primary Examiner — Christian Fronda
(74) Attorney, Agent, or Firm — Roetzel & Andress; Michael J. Keller; Verne A. Luckow

(57) ABSTRACT

This invention relates to novel enzymes and novel methods for producing the same. More specifically this invention relates to a variety of fungal enzymes. Nucleic acid molecules encoding such enzymes, compositions, recombinant and genetically modified host cells, and methods of use are described. The invention also relates to a method to convert lignocellulosic biomass to fermentable sugars with enzymes that degrade the lignocellulosic material and novel combinations of enzymes, including those that provide a synergistic release of sugars from plant biomass. The invention also relates to a method to release cellular content by degradation of cell walls. The invention also relates to methods to use the novel enzymes and compositions of such enzymes in a variety of other processes, including washing of clothing, detergent processes, biorefining, deinking and biobleaching of paper and pulp, and treatment of waste streams.

11 Claims, 9 Drawing Sheets

(56) References Cited

U.S. PATENT DOCUMENTS

| | | |
|---|---|---|
| 5,695,985 A | 12/1997 | Jensen et al. |
| 5,705,358 A | 1/1998 | Gouka et al. |
| 5,728,547 A | 3/1998 | Gwynne et al. |
| 5,753,477 A | 5/1998 | Chan |
| 5,763,192 A | 6/1998 | Kauffman et al. |
| 5,763,254 A | 6/1998 | Woldike et al. |
| 5,770,356 A | 6/1998 | Light, II et al. |
| 5,776,730 A | 7/1998 | Stuart |
| 5,780,279 A | 7/1998 | Matthews et al. |
| 5,783,385 A | 7/1998 | Treco et al. |
| 5,783,431 A | 7/1998 | Peterson et al. |
| 5,811,381 A | 9/1998 | Emalfarb et al. |
| 5,820,866 A | 10/1998 | Kappler et al. |
| 5,824,485 A | 10/1998 | Thompson et al. |
| 5,830,696 A | 11/1998 | Short |
| 5,834,191 A | 11/1998 | Radford et al. |
| 5,837,847 A | 11/1998 | Royer et al. |
| 5,849,541 A | 12/1998 | Vinci et al. |
| 5,858,657 A | 1/1999 | Winter et al. |
| 5,871,907 A | 2/1999 | Winter et al. |
| 5,879,921 A | 3/1999 | Cherry et al. |
| 5,939,250 A | 8/1999 | Short |
| 5,955,316 A | 9/1999 | Conneely et al. |
| 5,958,672 A | 9/1999 | Short |
| 5,965,384 A | 10/1999 | Boel et al. |
| 5,969,108 A | 10/1999 | McCafferty et al. |
| 5,989,814 A | 11/1999 | Frankel et al. |
| 6,015,707 A | 1/2000 | Emalfarb et al. |
| 6,017,731 A | 1/2000 | Tekamp-Olson et al. |
| 6,022,725 A | 2/2000 | Fowler et al. |
| 6,025,185 A | 2/2000 | Christensen et al. |
| 6,030,779 A | 2/2000 | Short |
| 6,046,021 A | 4/2000 | Bochner |
| 6,054,267 A | 4/2000 | Short |
| 6,057,103 A | 5/2000 | Short |
| 6,060,305 A | 5/2000 | Royer et al. |
| 6,066,493 A | 5/2000 | Shuster et al. |
| 6,121,034 A | 9/2000 | Laroche et al. |
| 6,174,673 B1 | 1/2001 | Short et al. |
| 6,184,026 B1 | 2/2001 | Shuster et al. |
| 6,518,042 B1 | 2/2003 | Borchert et al. |
| 6,573,068 B1 | 6/2003 | Milne Edwards et al. |
| 6,573,086 B1 | 6/2003 | Emalfarb et al. |
| 7,122,330 B2 | 10/2006 | Emalfarb et al. |
| 7,399,627 B2 | 7/2008 | Emalfarb et al. |
| 7,794,962 B2 | 9/2010 | Emalfarb et al. |
| 7,883,872 B2 | 2/2011 | Gusakov et al. |
| 7,892,812 B2 | 2/2011 | Emalfarb et al. |
| 7,906,309 B2 | 3/2011 | Emalfarb et al. |
| 2003/0157595 A1 | 8/2003 | Emalfarb et al. |
| 2003/0176672 A1 | 9/2003 | Salcedo et al. |
| 2004/0002136 A1 | 1/2004 | Emalfarb et al. |
| 2005/0191736 A1 | 9/2005 | Brown et al. |
| 2006/0005279 A1 | 1/2006 | Dotson et al. |
| 2006/0053514 A1 | 3/2006 | Wu et al. |
| 2006/0105361 A1 | 5/2006 | Rothstein et al. |
| 2006/0134747 A1 | 6/2006 | Baldwin et al. |
| 2006/0218671 A1 | 9/2006 | Brown et al. |
| 2007/0077630 A1 | 4/2007 | Harris et al. |
| 2009/0280105 A1 | 11/2009 | Gusakov et al. |

FOREIGN PATENT DOCUMENTS

| | | |
|---|---|---|
| EP | 0194276 B2 | 11/1993 |
| EP | 0239400 B1 | 8/1994 |
| EP | 0451216 B1 | 1/1996 |
| EP | 1022335 A1 | 7/2000 |
| EP | 0215594 B2 | 10/2003 |
| GB | 1368599 A | 10/1974 |
| GB | 2094826 | 9/1982 |
| GB | 2094826 A | 9/1982 |
| GB | 2289218 A | 11/1995 |
| JP | 50-132269 | 10/1975 |
| JP | 50-132269 A | 10/1975 |
| JP | 11-304666 A | 11/1999 |
| WO | 8601533 A1 | 3/1986 |
| WO | 9100092 A1 | 1/1991 |
| WO | 9100920 A2 | 1/1991 |
| WO | 9109967 A1 | 7/1991 |
| WO | 9109968 A1 | 7/1991 |
| WO | 9213831 A1 | 8/1992 |
| WO | 9404673 A1 | 3/1993 |
| WO | 9307277 A1 | 4/1993 |
| WO | 9311249 A1 | 6/1993 |
| WO | 9413820 A1 | 6/1994 |
| WO | 9602563 A1 | 2/1996 |
| WO | 9629391 A1 | 9/1996 |
| WO | 9709438 A1 | 3/1997 |
| WO | 9713853 A1 | 4/1997 |
| WO | 9726330 A2 | 7/1997 |
| WO | 9727363 A1 | 7/1997 |
| WO | 9815633 A1 | 4/1998 |
| WO | 9932617 A2 | 7/1999 |
| WO | 9951756 A2 | 10/1999 |
| WO | 9964582 A2 | 12/1999 |
| WO | 9967639 A1 | 12/1999 |
| WO | 0000632 A1 | 1/2000 |
| WO | 0020555 A2 | 4/2000 |
| WO | WO 00/20555 | 4/2000 |
| WO | WO 01/25468 | 5/2000 |
| WO | 0050567 A1 | 8/2000 |
| WO | 0056893 A1 | 9/2000 |
| WO | 0056900 A2 | 9/2000 |
| WO | 0078997 A1 | 12/2000 |
| WO | 0109352 A2 | 2/2001 |
| WO | 0125468 A1 | 4/2001 |
| WO | 0179558 A1 | 10/2001 |
| WO | WO 01/79558 | 10/2001 |
| WO | 200431367 A2 | 4/2004 |
| WO | WO 2004/031378 | 4/2004 |
| WO | WO 2006/114094 | 11/2006 |
| WO | WO 2006/114095 | 11/2006 |

OTHER PUBLICATIONS

Benen et al., "Characterization of *Aspergillus niger* Pectate Lyase A," Biochemistry 2000, 39, 15563-15569.

Bhatawadekar, "Studies on Optimum conditions of Enzymatic desizing of LTKP sized fabric by cellulase—steeping and cellulase-padding methods," (May 1983) Journal of the Textile Association, pp. 83-86.

Blum et al., "Enzymic Degradation of Cellulose Fibers;" Reports of the Shizuoka Prefectural Hamamatsu Textile Industrial Research Institute No. 24 (1985) Textile Research Journal, vol. 22, No. 3, 178-192 (1952).

Boonyapakron et al., Mitochondrial DNA, vol. 16, No. 5, 2005, pp. 372-378.

De Vries et al., "aguA, the Gene encoding an extracellular a-Glucuronidase from *Aspergillus tubingensis*, is specifically induced on zylose and not on glucuronic acid," Journal of Bacteriology, 1998, pp. 243-249.

De Vries et al., "*Aspergillus* Enzymes involved in degradation of plant cell wall polysaccharides," Microbiol. and Molecular Biol. Reviews 2001, 497-522.

Ding et al., "Cloning of multiple cellulase cDNAs from *Volvariella volvacea* and their differential expression during substrate colonization and fruiting," FEMS Microbiol Lett 263 (2006) 2007-213.

Foreman et al., "Transcriptional Regulation of Biomass-degrading Enzymes in the Filamentous Fungus *Trichoderma reesei*", Journal of Biological Chemistry, vol. 278, No. 34, Issue of Aug. 22, pp. 31988-31997,2008.

Galante, Y.M., Formantici, C. Enzyme applications in detergency and in manufacturing industries. Current Organic Chemistry. 2003, 7, 1399-1422.

Genbank accession O74240, used as source material for the Subramaniam reference.

Gibbs et al., "Sequencing and Expression of a B-Mannanase Gene from the extreme thermophile dictyoglomus thermophilum Rt46B.1, and characteristics of the Recombinant Enzyme," Current Microbiol. Vio. 39 (1999), pp. 351-357.

(56) References Cited

OTHER PUBLICATIONS

Golan et al., "Crystal Structures of *Geobacillus stearothermophilus* a-Glucuronidase complexed with its substrate and products," J. Biological. Chem. vol. 279, No. 4, pp. 3014-3024, 2004.
Gordillo et al., "*Penicillium purpurogenum* produces a family 1 acetyl xylan esterase containing a carbohydrate-binding module: characterization of the protein and its gene," Mycol. Res. 110:1129 (2006).
Gusakov et al., "Design of highly efficient cellulase mixtures for enzymatic hydrolysis of cellulose," Biotechnol. Bioeng. vol. 97, No. 5, 2007, pp. 1028-1038.
Gusakov et al., Microassays to control the results of cellulase treatment of denim fabrics; Textile Chemist and Colorist and American Dyestuff Reporter, (2000), V.32, N. 5, p. 42.
Hahn-Hagerdal et al., "Bio-ethanol—the fuel of tomorrow from the residues of today." Trends in Biotechnology. 2006, 24 (12), 549-556.
Helmut Uhlig. Industrial enzymes and their applications. Translated and updated by Elfriede M. Linsmaier-Bednar. John Wiley & Sons, Inc 1998, p. 454 (in particular, chapters 5.1, 5.2, 5.3, 5.4, 5.5, 5.6, 5.7, 5.9, 5.10, 5.11, and 5.13).
Heneghan et al., "Cloning, characterisation and expression analysis of a-glucuronidase from the thermophilic fungus talaromyces emersonii," Enzyme and Microbial Technology 41 (2007) 677-682.
Himmel et al., "Cellulase for commodity products from cellulosic biomass." Current Opinion in Biotechnology. 1999, 10, 358-364.
Ho et al., "Sequence analysis of the *Aspergillus nidulans* pectate lyase pelA gene and evidence for binding of promoter regions to CREA, a regulator of carbon catabolite repression," Curr. Genet. 1995, 27:142-149.
Hong et al., "Unusual hydrophobic linker region of B-glucosidase (GBLII) from thermoascus aurantiacus is required for hyper-activation by organic solvents," Appl. Microbiol. Biotechnol. 2006, 73:80-88.
Huertas-Gonzalez et al., "Cloning and characterization of pI1 encoding an in planta-secreted pectate lyase of *Fusarium oxysporum*," Curr. Genet (1999) 35:36-40.
Karlsson et al., "Homologous expression and characterization of Cel61A (EG IV) of *Trichoderma reesei*," Eur. J. Biochem 268, 6498-6507 (2001).
Kauppinen et al., "Molecular cloning and characterization of a chamnoglacturonan acetylesterase from *Aspergillus aculeatus*," J. Biol. Chem. vol. 270, No. 45, pp. 27172-27178 1995.
Kormelink et al., "Mode of action of the xylan-degrading enzymes from *Aspergillus awamori* on alkali-extractable ceral arabinoxylans," Carbohydrate Research, 249 (1993) 355-367.
Kormelink et al., "Purification and characterization of three endo-(1,4)-B-xylanases and one B-xylosidase from *Aspergillus awamori*," 1993b, J. Biotechnol. 27:249-265.
Kotake et al., "Molecular cloning and expression in *Escherichia coli* of a trichoderma viride endo-B-(1-6)-galactanase gene", Biochem. J. 2004, 377, 749-755.
Kramer et al., "Insect Chitinases: Molecular Biology and Potential Use as Biopesticides," Insect Biochem Mol Biol. 27:887 (1997).
Leisola et al., "Determination of the Solubilizing Activity of a Cellulase Complex with Dyed Substrates," (1976) Analytical Biochemistry, v. 70, p. 592.
Mantyla et al., "Production in *Trichoderma reesei* of three xylanases from *Chaetomium thermophilum*: a recombinant thermozylanase for biobleaching of kraft pulp," Appl. Microbiol. Biotechnol. (2007) 76(2):377-86.
Margolles-Clark et al., "The x-clucuronidase-encoding gene of *Trichoderma reesei*," Gene 172 (1996) 171-172.
Martinez, D. et al., "Genome sequencing and analysis of the biomass-degrading fungus *Trichoderma reesei* (syn. *Hypocrea jecorina*)," 2008 Nature Biotechnol. 26, 553-560.
Merino et al., 2007, "Progree and Challenges in Enzyme Development for Biomass Utilization," Advances in Biochemistry and Engineering/Biotechnology 108, 95-120.

Mielenz, J.R. Ethanol production from biomass: technology and commercialization status. Current Opinion in Microbiology. 2001, 4, 324-329.
Pages et al., "A Phamnoglacturonan Lyase in the Clostridium cellulolyticum cellulosome," Journal of Bacteriology vol. 185 No. 16 pp. 4727-4733 2003.
Reese et al., "Chitin induces accummulation in tissue of innate immune cells associated with allergy," Nature 447:92 (2007).
Roller, S., Dea, I.C.M. Biotechnology in the production and modification of biopolymers for foods. Critical Reviews in Biotechnology. 1992, 12(3), 261-277.
Saha et al., "Enzymatic hydrolysis and fermentation of lime pretreated wheat straw to ethanol," J Chem Technol Biotechnol 82:913-919 (2007).
Sakamoto et al., "Molecular characterization of a *Penicillium chrysogenum* exo-1,5-a-L-arabinanase that is structurally distinct from other arabinan-degrading enzymes," FEBS Letters 560, (2004) 199-204.
Saloheimo et al., "cDNA cloning of a *Trichoderma reesei* cellulase and demonstration of endoglucanase activity by expression in yeast," Eur. J. Biochem. 249, 584-591 (1997).
Sheehan et al., "Energy, and the environment: a strategic perspective on the U.S. Department of Energy's Research and Development Activities for Bioethanol." Biotechnology Progress. 1999, 15, 817-827.
Shih et al., "A comparison of the pectate lyase genes, pel-1 and pel-2, of colletotrichum gloeosporidoides f.sp. Malvae and the relationship between their expression in culture and during necrotrophic infection," Gne 243 (2000) 139-150.
Sorensen et al., "Efficiencies of designed enzyme combinations in releasing arabinose and xylose from wheat arabinoxylan in an industrial ethanol fermentation residue," 2005, Enzyme Microb. Technol. 36, 773-784.
Sorensen et al., "Enzymatic Hydrolysis of Wheat Arabinoxylan by a recombinant "Minimal" Enzyme cocktail containing B-Xytosidase and novel endo-1,4-B-Xylanase and a-L-Arabinofuranosidase activities," 2007, Biotechnol. Progr. 23, 100-107.
Sørensen HR, Jørgensen CT, Hansen CH, Jørgensen CI, Pederson S, Meyer AS (2006). A novel GH43 α-L-arabinofuranosidase from Humicola insolens: mode of action and synergy with GH51 α-L-arabinofuranosidases on wheat arabinoxylan. Appl Microbiol Biotechnol 73:850-861.
Subramaniam et al., "Cloning and characterization of a thermostable cellobiose dehydrogenase from *Sporotrichum thermophile*", Arch. Biochem. Biophys.; Vo 365, No. 2, p. 223-230; May 15, 1999.
Takami et al., "Complete genome sequence of the alkaliphilic bacterium bacillus halodurans and genomic sequence comparison with *Bacillus subtilis*," Nucleic Acids Research 2000, vol. 28, No. 21, 4317-4331.
Van den Broek et al., "Cloning and characterization of arabinoxylan arabinofuranohydrolase-D3 (AXHd3) from bifidobacterium adolescentic DSM29983," Appl. Microbiol. Biotechnol (2005) 67:641-647.
Van Laere et al., "A new arabinofuranohydrolase from Bifldobacterium adolescentis able to remove arabinosyl residues from double-substituted xylose units in arabinoxylan," Appl. Microbiol. Biotechnol. (1997) 47:231-235.
Verbruggen et al., "Enzymatic degradation of sorghum glucuronoarabinoxylans leading to tentative structures," Carbohydrate Research 306 (1998) 275-282.
Viikari et al., Use of cellulases in pulp and paper applications. In: "Carbohydrates from *Trichoderma reesei* and other microorganisms. Structure, Biochemistry, Genetics and Applications." Editors: Mark Claessens, Wim Nerinckx, and Kathleen Piens. The Royal Society of Chemistry 1998, 245-254.
Xu et al., "Humicola insolens cellobiose dehydrogenase: cloning, redox chemistry, and "logic gate"-like dual functionality," Enzyme and Microbial Technology 28 (2001) 744-753.
Yano et al., Biosci Biotechnol Biochem. 70:1754 (2006).
International Search Report for International (PCT) Application No. PCT/US08/75464, mailed Feb. 12, 2009.
Written Opinion for International (PCT) Application No. PCT/US08/75464, mailed Feb. 12, 2009.

(56) References Cited

OTHER PUBLICATIONS

Aleksenko et al. 1997. Autonomous Plasmid Replication in *Aspergillus nidulans*: AMA1 and MATE Elements. Fungal Genetics and Biology, vol. 21, pp. 373-387.
Aleksenko et al. 1996. Gene expression from replicating plasmids in *Aspergillus nidulans*. Mol. Gen. Genet. vol. 253, pp. 242-246.
Archer et al. 1997. The Molecular Biology of Secreted Enzyme Production by Fungi. Critical Reviews in Biotechnology, vol. 17, No. 4, pp. 273-306.
Armesilla et al. 1994. CEL1: a novel cellulose binding protein secreted by *Agaricus bisporus* during growth on crystalline cellulose. FEMS Microbiol. Lett. vol. 116, pp. 293-300.
Arnau et al. 1991. Integrative transformation by homologous recombination in the zygomycete Mucor circinelloides. Mol. Gen. Genet., vol. 225, pp. 193-198.
Arnold et al. 1999. Directed evolution of biocatalysts. Current Opinion in chemical Biology, vol. 3, pp. 54-59.
Arnold et al. 1999. Encyclopedia of Bioprocess Technology: Fermentation, Biocatalysis, and Bioseparation. Flickinger et al., eds. John Wiley & Sons, pp. 971-987.
Asgeirsdottir et al. 1999. A Sandwiched-Culture Technique for Evaluation of Heterologous Protein Production in a Filamentous Fungus. Applied and Environmental Microbiology, vol. 65, No. 5, pp. 2250-2252.
Bajpai et al.1998. Deinking with Enzymes: A Review. TAPPI Journal. vol. 81, No. 12, pp. 111-117.
Benen et al. 2000. Characterization of *Aspergillus niger* Pectate Lyase A. Biochemistry, vol. 39, pp. 15563-15569.
Berges, T. et al. 1993. Cloning of an *Aspergillus niger* invertase gene by expression in *Trichoderma reesei*. Springer-verlag, vol. 24, pp. 53-59.
Bhatawadekar. 1983. Studies on Optimum Conditions of Dnzymatic Desizing of LTKP Sized Fabric by Cellulase—Steeping and Cellulase-Padding Methods. Journal of the Textile Association, May 1983, pp. 83-86.
Bretthauer et al. 1999. Glycosylation of *Pichia pastoris*-derived proteins. Biotechnol. Appl. Biochem., vol. 30, pp. 193-200.
Bukhtojarov et al. 2004. Cellulase Complex of the Fungus *Chrysosporium lucknowense*: Isolation and Characterization of Endoglucanases and Cellobiohydrolases. Biochemistry (Mosc), May 2004, vol. 69, No. 5, pp. 542-551 (Abstract).
Buxton et al. 1984. The transformation of mycelial spheroplasts of *Neurospora crassa* and the Attempted Isolation of an Autonomous Replicator. Mol. Gen. Genet, vol. 196, pp. 339-344.
Canevascini, G. et al. 1983. Fractionation and Identification of Cellulases and Other Extracellular Enzymes Produced by Sporotrichum (Chrysosporium) Thermophile During Growth on Cellulose or Cellobiose. Can. J. Microbiol., vol. 29, pp. 1071-1080.
Chakraborty et al. 1990. Transformation of Filamentous Fungi by Electroporation. Nucleic Acids Research, vol. 18, No. 22, p. 6637.
De Vries, R.P. and Visser, J., 2001. *Aspergillus* enzymes involved in degradation of plant cell wall polysaccharides. Microbiol. Mol. Biol. R., 65, 497-522.
Degroot et al., *Agrobacterium tumefaciens*-mediated transformation of filamentous fungi, Nature Biotechnology, vol. 16, pp. 839-842 (1998).
Deutsch et al., "Intron-exon structures of eukaryotic model organisms," Nucleic Acids Research, vol. 27, No. 15, pp. 3219-3228 (1999).
Ding et al. Cloning of multiple cellulose cDNAs from *Volvariella volvacea* and their differential expression during substrate colonization and fruiting. FEMS Microbiol. Lett 2006, vol. 263, pp. 207-213.
Eriksson, K. et al. Extracellular Enzyme System Utilized by the Fungus Sporotrichum Pulverulentum (Chrysosporium Lignorum) for the Breakdown of Cellulose. 1, Separation, Purification, and Physico-Chemical Characterisation of Five Endo-1, 4-Beta-Glucanases. European Journal of Biochemistry, 1975, vol. 51, pp. 193-206.

Flanagan, P.W. et al. Physiological Groups of Decomposer Fungi on Tundra Plant Remains. In Soil Organisms and Decomposition in Tundra, A.J. Holding et al., Eds., Tundra Biome Steering Committee (Stockholm), 1974, pp. 159-181.
Foreman et al. Transcriptional Regulation of Biomass-Degrading Enzymes in the Filamentous Fungus *Trichoderma reesei*. J. Biol. Chem. 2003, vol. 278, pp. 31988-31997.
Gems et al., "An 'instant gene bank' method for gene cloning by mutant complementation," Mol. Gen. Genet, vol. 242, pp. 467-471 (1994).
Gems et al., "Co-transformation with autonomously-replicating helper plasmids facilitates gene cloning from an *Aspergillus nidulans* gene library," Curr. Genet., vol. 24, pp. 520-524 (1993).
Gordillo et al. Penicillium Purpurogenum Produces a Family 1 Acetyl Xylan Esterase Containing a Carbohydrate-Binding Module: Characterization of the Protein and Its Gene. Mycol. Res., 2006, vol. 110, p. 1129.
Goudar et al. Influence of microbial concentration on the rheology of non-Newtonian fermentation broths. Appl. Microbiol. Biiotechnol. 1999, vol. 51, pp. 310-315.
Gunf-Fusox, accession No. p46239, Nov. 1, 1995, P.O. Sheppard et al. The Use of Conserved Cellulase Family-Specific Sequences to Clone Cellulase Homologue cDNAs from Fusarium Oxysporum.
Gusakov, A.V. et al. Design of Highly Efficient Cellulase Mixtures for Enzymatic Hydrolysis of Cellulose. Biotechnol. Bioeng., 2007, vol. 97, No. 5, pp. 1028-1038.
Gusakov, A.V. et al. Purification, Cloning and Characterization of Two Forms of Thermostable and Highly Active Cellobiohydrolase I (Ce17A) Produced by the Industrial Strain of *Chrysosporium lucknowense*. Enzyme Microb. Technol. 2005, vol. 36, pp. 57-69.
Gusakov, A.V. Microassays to Control the Results of Cellulase Treatment of Denim Fabrics. Textile Chemist and Colorist and American Dyestuff Reporter, 2000, vol. 32, No. 5, pp. 42-47.
Hahn-Hagerdal et al. Bio-ethanol—The Fuel of Tomorrow from the Residues of Today. Trends in Biotechnology, 2006, vol. 24, No. 12, pp. 549-556.
Harmsen Martin C. et al. 1992. Sequence Analysis of the Glyceraldehyde-3-phosphate dehydrogenase genes from the basidiomycetes *Schizopyllum commune, Phanerochaete chrysosporium* and *Agaricus bisporus*. Current Genetics, vol. 22, No. 6, pp. 447-454.
Hong et al. Unusual hydrophobic linker region of B-glucosidase (BGLII) from *Thermoascus aurantiacus* is required for hyper-activation by organic solvents. *Applied Microbiol. Biotechnol.*, 2006, vol. 73, pp. 80-88.
Huertas-Gonzalez et al. Cloning and characterization of pl1 encoding an in planta-secreted pectate lyase of *Fusarium oxysporum*. Curr Genet, 1999, vol. 35, pp. 36-40.
Hurst, J.L. et al Association between Chrysosporium Pannorum and Mucor Hiemalis in Poa Flabellata Litter. Trans. Br. Mycol. Soc., 1983, vol. 81, No. 1, pp. 151-153.
Iikura, H. et al. Cloning of a Gene Encoding a Putative Xylanase with a Cellulose-Binding Domain from Humicola Grisea. Bioscience Biotechnology and Biochemistry, 1997, vol. 61, No. 9, pp. 1593-1595.
Janeckova et al. Ceska Mykologie (1977), vol. 331, No. 4, pp. 206-213 (Abstract).
Jeenes et al., "Heterologous Protein Production by Filamentous Fungi," Biotechnology & Genetic Engineering Reviews, vol. 9, pp. 327-367 (1991).
Johnstone et al. Cloning an *Aspergillus nidulans* developmental gene by transformation. Embo J., 1985, vol. 4, pp. 1307-1311.
Joo et al., "A high-throughput digital imaging screen for the discovery and directed evolution of oxygenases," Chemistry & Biology, vol. 6, pp. 699-706 (1999).
Judelson et al., "Transformation of the Oomycete Pathogen, *Phytophthora infestans*," Molecular Plant-Microbe Interactions, vol. 4, No. 6, pp. 602-607 (1991).
Kauppinen et al. Molecular Cloning and Characterization of a Rhamnogalacturonan Acetylesterase from *Aspergillus aculeatus*. J. Biol Chem, 1995, vol. 270, p. 27172-27178.
Kormelink F.J.M. et al. Mode of Action of the Xylan-Degrading Enzymes from *Aspergillus awamori* on Alkali-Extractable Cereal Arabinoxylans. Carbohydr. Res, 1993, vol. 249, pp. 355-367.

(56) References Cited

OTHER PUBLICATIONS

Kormelink et al. Purification and Characterization of Three Endo-(1,4)-B-xylanases and one B-xylosidase from *Aspergillus awamori*. J. Biotechnol. 1993, vol. 27, pp. 249-265.
Kotake et al. Molecular cloning and expression in *Escherichia coli* of a Trichoderma viride endo-B-(1-6)-galactanase gene. Biochem J.., 2004, vol. 377, pp. 749-755.
Kramer et al. Insect Chitinases: Molecular Biology and Potential Uses as Biopesticides. Insect Biochem Mol Biol., 1997, vol. 27, p. 887.
Kruszewska, "Heterologous expression of genes in filamentous fungi," Acta Biochimica Polonica, vol. 46, No. 1, pp. 181-195 (1999).
Kuchner et al., "Directed evolution of enzyme catalysts," Trends in Microbiology, vol. 15, pp. 523-530 (1997).
Liou et al., "Transformation of a Leu-Mutant of *Rhizopus niveus* with the leuA Gene of Mucor circinelloides," Biosci. Biotech. Biochem., vol. 56, No. 9, pp. 1503-1504 (1992).
Mandels, M. et al. Induction of Cellulase in *Trichoderma viride* as Influenced by Carbon Sources and Metals. J. Bacteriol., 1957, vol. 73, pp. 269-278.
Mantyla et al. Production in *Trichoderma reesei* xylanases of three xylanases from *Chaetomium thermophilum*: a recombinant thermoxylanase for biobleaching of kraft pulp. Appl. Microbiol. Biotechnol., 2007, vol. 76, pp. 377-386.
Maras et al., "Filamentous fungi as production organisms for glycoproteins of bio-medical interest," Glycoconjugate Journal, vol. 16, pp. 99-107 (1999).
Martinez, D. et al. Genome Sequencing and Analysis of the Biomass-Degrading Fungus *Trichoderma reesei* (syn. *Hypocrea jecorina*), Nature Biotechnol., 2008, vol. 26, pp. 553-560.
May et al., "Inverting enantioselectivity by directed evolution of hydantoinase for improved production of L-methionine," Nature Biotechnology, vol. 18, pp. 317-320 (2000).
Meynial-Salles et al. In vitro glycosylation of proteins: An enzymatic approach. J. Biotechnol., 1996, vol. 46, pp. 1-14.
Mielenz. Ethanol Production from Biomass: Technology and Commercialization Status. Current Opinion in Microbiology, 2001, vol. 4, pp. 324-329.
Miyazaki et al., "Directed Evolution Study of Temperature Adaptation in a Psychrophilic Enzyme," J. Mol. Biol., vol. 297, pp. 1015-1026 (2000).
Munoz-Rivas et al., "Transformation of the basidiomycete, Schizophyllum commune," Mol. Gen. Gent., vol. 205, pp. 103-106 (1986).
Oberson, J. et al. Comparative investigation of cellulose-degrading enzyme systems produced by different strains of *Myceliophthora thermophila* (Apinis) v. Oorschot. Enzyme Microb. Technol. 1992, vol. 14, pp. 303-312.
Pages et al. ARhamnogalacturonan Lyase in the Clostridium cellulolyticum Cellulosome. J. Bacteriol. vol. 185, pp. 4727-4733 (2003).
Peberdy, "Extracellular Proteins in Fungi: A Cytological and Molecular Perspective," Acta Microbiologica et Immunologica Hungarica, vol. 46, pp. 165-174 (1999).
Qureshi, M.S.A. et al. Cellulolytic Activity of Some Thermophilic and Thermotolerant Fungi of Pakistan, Viologia, vol. 26, Nos. 1-2, 1980, pp. 201-217.
Reese, E.T. et al. Beta-D-1,3 Glucanases in Fungi. Can. J. Microbiol. 1959, vol. 5, pp. 173-185.
Ridder, R. et al. 1992. Sequence Analysis of the Gene Coding for Glyceraldehyde-3-Phosphate Dehydrogenase GPD of Podospora-anserina use of Homologous Regulatory Sequences to Improve Transformation Efficiency. Current Genetics, vol. 21, No. 3, pp. 207-213.
Roller et al. Biotechnology in the Production and Modification of Biopolymers for Foods. Critical Reviews in Biotechnology, 1992, vol. 12, No. 3, pp. 261-277.
Ruiz-Roldan, M.C. et al. *Fusarium oxysporum* f.s.p. *lycopersici*. Family F xylanase (XYL3). Accession No. o59937, Aug 1, 1998.

Sakamoto et al. Molecular characterization of a Penicillium chrysogenum exo-1,5-a-L-arbinanase that is structurally distinct from other arabinan-degrading enzymes. FEBS Lett. 2004, vol. 506, pp. 199-204.
Saloheimo et al. cDNA cloning of a *Trichoderma reesei* cellulose and demonstration of endoglucanase activity by expression in yeast. Eur. J. Biochem, 1997, vol. 249, p. 584-591.
Seffernick, et al. 2001. Melamine deaminase and atrazine chloroydrolase: 98 percent identical but functionally different. Journal of Bacteriology, vol. 183, No. 8, pp. 2405-2410.
Sheehan et al. Enzymes, energy and the Environment: A Strategic Perspective on the U.S. Department of Energy's Research and Development Activities for Bioethanol. Biotechnology Progress, 1999, vol. 15, pp. 817-827.
Sheppard, P.O. et al. 1994. The Use of Conserved Cellulse Family-Specific Sequences to Clone Cellulase Homologue cDNAs from *Fusarium oxysporum*, XP002154884, Abstract.
Sheppard, P.O. et al. The Use of Conserved Cellulse Family-Specific Sequences to Clone Cellulase Homologue cDNAs from *Fusarium oxysporum*. Gene, 1994, vol. 150, pp. 163-167.
Shin et al. A comparison of the pectate lyase genes, pel-1 and pel-2, of *Colletotrichum gloeosporioides* f.sp. malvae and the relationship between their expression in culture and during necrotrophic infection. Gene, 2000, vol. 243, pp. 139-150.
Sorensen et al. Efficiencies of Designed Enzyme Combinations in Releasing Arabinose and Xylose from Wheat Arabinoxylan in an Industrial Ethanol Fermentation Residue. Enzyme Microb. Technol., 2005, vol. 36, pp. 773-784.
Sørensen et al. A Novel GH43 alpha-L-arabinofuranosidase from Humicola insolens: Mode of Action and Synergy with GH51 alpha-L-arabinofuranosidases on wheat arabinoxylan. Appl. Microbiol. Biotechnol. 2006, vol. 73, pp. 850-861.
Sørensen et al. Enzymatic Hydrolysis of Wheat Arabinoxylan by a Recombinant "Minimal" Enzyme Cocktail Containing B-Xylosidase and Novel Endo-1,4-B-Xylanase and a-L-Arabinofuranosidase Activities. Biotechnol. Progr., 2007, vol. 23, pp. 100-107.
Takami et al. Complete genome sequence of the alkaliphilic bacterium *Bacillus halodurans* and genomic sequence comparison with *Bacillus subtilis*. Nucleic Acid Res, 2000, vol. 28, pp. 4317-4331.
Takishima, S. et al. Cloning, Sequencing, and Expression of the Cellulase Genes of *Humicola grisea* Var. *thermoida*. Accession No. D63515, Aug. 21, 1995.
Takashima, S. et al. Cloning, Sequencing, and Expression of the Cellulase Genes of *Humicola grisea* Var. *Thermoidea*. Journal of Biotechnology, 1996, vol. 50, pp. 137-147.
Unkles, S.E. et al. The development of a homologous transformation system for *Aspergillus oryzae* based on the nitrate assimilation pathway: A convenient and general selection system for filamentous fungal transformation. Mol. Gen. Genet., 1989, vol. 218, pp. 99-104.
Uzcategui et al. The 1,4-b-d-glucan glucanohydrolases from Phanerochaete chrysosporium. Re-assessment of their significance in cellulose degradation mechanisms. Journal of Biotechnology, 1991, vol. 21, pp. 143-160.
Van de Rhee et al., "Transformation of the cultivated mushroom, *Agaricus bisporus*, to hygromycin B resistance," Mol. Gen. Genet., vol. 250, pp. 252-258 (1996).
Van den Broek L.A.M. et al. Cloning and Characterization of Arabinoxylan Arabinofuranosidase-D3 (AXHd3) from *Bifidobacterium adolescentis* DSM 20083. Appl. Microbiol. Biotechnol, 2005, vol. 67, pp. 641-647.
Van Laere, D.M.J. et al. A New Arabinofuranohydrolase from *Bifidobacterium adolescentis* Able to Remove Arabinosyl Residues from Double-Substitutes Xylose Units in Arabinoxylan. Appl. Microbiol. Biotechnol, 1997, vol. 47, pp. 231-235.
Van Oorschot, a Revision of Chrysosporium and Allied Genera. Studies in Mycology, 1980, No. 20, pp. 1-3, 8-9 and 32-35.
Van Zeijl et al., "An improved colony-PCR method for filamentous fungi for amplification of PCR-fragments of several kilobases," Journal of Biotechnology, vol. 59, pp. 221-224 (1998).
Verdoes et al., "characterization of an efficient gene cloning strategy for *Aspergillus niger* based on an autonomously replicating plasmid: cloning of the nicB gene of A. niger," Gene, vol. 146, pp. 159-165 (1994).

(56) References Cited

OTHER PUBLICATIONS

Viikari et al. Use of Cellulases in Pulp and Paper Applications. In Carbohydrates from *Trichoderma reesei* and Other Microorganisms. Structure, Biochemistry, Genetics, and Applications. Claessens, M. et al. eds. The Royal Society of Chemistry, 1998, pp. 245-254.

Xu et al. Humicola insolens cellobiose dehydrogenase: cloning, redox chemistry, and "logic gate"-like dual functionality. Enzyme Microb. Technol., 2001, vol. 28, p. 744-753.

Yano et al. Cloning and Expression of an a-1,3-Glucanase Gene from *Bacillus circulans* KA-304: The Enzyme Participates in Protoplast Formation of Schizophyllum Commune. Biosci Biotechnol. Biochem., 2006, vol. 70, pp. 1754-1763.

Food and Drug Administration. Agency Response Letter GRAS Notice No. GRN 000292, dated Sep. 29, 2009, from Mitchell A. Cheesman, Acting Director, to Richard H. Jundzil, Dyadic International (USC), Inc. (hyper text transfer protocol://www.fda.gov).

Office Action, dated May 27, 2010, for U.S. Appl. No. 12/047,709, filed Mar. 13, 2008, entitled "Transformation System in the Field of Filamentous Fungal Hosts."

Notice of Allowance and Fee(s) Due, dated Oct. 28, 2010, for U.S. Appl. No. 10/257,629, filed Apr. 11, 2003, entitled "Novel Expression-Regulating Sequences and Expression Products in the Field of Filamentous Fungi."

Notice of Allowance and Fee(s) Due, dated Dec. 1, 2010, for U.S. Appl. No. 11/833,133, filed Aug. 2, 2007, entitled "Novel Fungal Enzymes."

\* cited by examiner

BX11 ENZYMES HAVING XYLOSIDASE ACTIVITY

CROSS-REFERENCE TO RELATED APPLICATIONS

This application claims the benefit of priority under 35 U.S.C. §119(e) of U.S. Provisional Application No. 60/970,876, filed on Sep. 7, 2007, the entire disclosure of which is incorporated herein by reference.

REFERENCE TO SEQUENCE LISTING

This application contains a Sequence Listing submitted as an electronic text file named "5671-7_ST25.txt", having a size in bytes of 1030 kb, and created on Aug. 30, 2008. The information contained in this electronic file is hereby incorporated by reference in its entirety pursuant to 37 CFR §1.52(e)(5).

FIELD OF THE INVENTION

This invention relates to novel enzymes and novel methods for producing the same. More specifically this invention relates to enzymes produced by fungi. The invention also relates to a method to convert lignocellulosic biomass to fermentable sugars with enzymes that degrade the lignocellulosic material and novel combinations of enzymes, including those that provide a synergistic release of sugars from plant biomass. The invention also relates to a method to release cellular contents by effecting degradation of the cell walls. The invention also relates to methods to use the novel enzymes and compositions of such enzymes in a variety of other processes, such as washing of clothing, detergent processes, animal feed, food, beverage, biorefining, deinking and biobleaching of paper and pulp, and treatment of air waste streams.

BACKGROUND OF THE INVENTION

Large amounts of carbohydrates in plant biomass provide a plentiful source of potential energy in the form of sugars (both five carbon and six carbon sugars) that can be utilized for numerous industrial and agricultural processes. However, the enormous energy potential of these carbohydrates is currently under-utilized because the sugars are locked in complex polymers, and hence are not readily accessible for fermentation. These complex polymers are often referred to collectively as lignocellulose. Sugars generated from degradation of plant biomass potentially represent plentiful, economically competitive feedstocks for fermentation into chemicals, plastics, and fuels, including ethanol as a substitute for petroleum.

For example, distillers' dried grains (DDG) are lignocellulosic byproducts of the corn dry milling process. Milled whole corn kernels are treated with amylases to liquefy the starch within the kernels and hydrolyze it to glucose. The glucose so produced is then fermented in a second step to ethanol. The residual solids after the ethanol fermentation and distillation are centrifuged and dried, and the resulting product is DDG, which is used as an animal feed stock. Although DDG composition can vary, a typical composition for DDG is: about 32% hemicellulose, 22% cellulose, 30% protein, 10% lipids, 4% residual starch, and 4% inorganics. In theory, the cellulose and hemicellulose fractions, comprising about 54% of the weight of the DDG, can be efficiently hydrolyzed to fermentable sugars by enzymes; however, it has been found that the carbohydrates comprising lignocellulosic materials in DDG are more difficult to digest. To date, the efficiency of hydrolysis of these (hemi) cellulosic polymers by enzymes is much lower than the hydrolytic efficiency of starch, due to the more complex and recalcitrant nature of these substrates. Accordingly, the cost of producing the requisite enzymes is higher than the cost of producing amylases for starch hydrolysis.

Major polysaccharides comprising lignocellulosic materials include cellulose and hemicelluloses. The enzymatic hydrolysis of these polysaccharides to soluble sugars (and finally to monomers such as glucose, xylose and other hexoses and pentoses) is catalyzed by several enzymes acting in concert. For example, endo-1,4-β-glucanases (EGs) and exo-cellobiohydrolases (CBHs) catalyze the hydrolysis of insoluble cellulose to cellooligosachharides (with cellobiose the main product), while β-glucosidaes (BGLs) convert the oligosaccharides to glucose. Similarly, xylanases, together with other enzymes such as α-L-arabinofuranosidases, ferulic and acetylxylan esterases and β-xylosidases, catalyze the hydrolysis of hemicelluloses.

Regardless of the type of cellulosic feedstock, the cost and hydrolytic efficiency of enzymes are major factors that restrict the widespread use of biomass bioconversion processes. The hydrolytic efficiency of a multi-enzyme complex in the process of lignocellulosic saccharification depends both on properties of the individual enzymes and the ratio of each enzyme within the complex.

Enzymes useful for the hydrolysis of complex polysaccharides are also highly useful in a variety of industrial textile applications, as well as industrial paper and pulp applications, and in the treatment of waste streams. For example, as an alternative to the use of pumice in the stone washing process, methods for treating cellulose-containing fabrics for clothing with hydrolytic enzymes, such as cellulases, are known to improve the softness or feel of such fabrics. Cellulases are also used in detergent compositions, either for the purpose of enhancing the cleaning ability of the composition or as a softening agent. Cellulases are also used in combination with polymeric agents in processes for providing a localized variation in the color density of fibers. Such enzymes can also be used for the saccharification of lignocellulosic biomass in waste streams, such as municipal solid waste, for biobleaching of wood pulp, and for deinking of recycled print paper. As with the hydrolysis of these polysaccharides in lignocellulosic materials for use as feedstocks described above, the cost and hydrolytic efficiency of the enzymes are major factors that control the use of enzymes in these processes.

Filamentous fungi are a source of cellulases and hemicellulases, as well as other enzymes useful in the enzymatic hydrolysis of major polysaccharides. In particular, strains of *Trichodenna* sp., such as *T. viride, T. reesei* and *T. longibrachiatum*, and *Penicillium* sp., and enzymes derived from these strains, have previously been used to hydrolyze crystalline cellulose. However, the costs associated with producing enzymes from these fungi, as well as the presence of additional, undesirable enzymes, remains a drawback. It is therefore desirable to produce inexpensive enzymes and enzyme mixtures that efficiently degrade cellulose and hemicellulose for use in a variety of agricultural and industrial applications.

SUMMARY OF THE INVENTION

In one embodiment, the present invention comprises an isolated nucleic acid molecule comprising a nucleic acid sequence selected from the group consisting of:

a) a nucleic acid sequence encoding a protein comprising an amino acid sequence selected from the group consisting of: SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, and SEQ ID NO:233.

b) a nucleic acid sequence encoding a fragment of the protein of (a), wherein the fragment has a biological activity of the protein of (a); and c) a nucleic acid sequence encoding an amino acid sequence that is at least about 70% identical to an amino acid sequence of (a) and has a biological activity of the protein comprising the amino acid sequence.

In some embodiments, the nucleic acid sequence encodes an amino acid sequence that is at least about 90%, at least about 95%, at least about 97% or at least about 99% identical to the amino acid sequence of (a) and has a biological activity of the protein comprising the amino acid sequence.

In some embodiments, the nucleic acid sequence encodes a protein comprising an amino acid sequence selected from the group consisting of: SEQ ID NO:2, SEQ ID NO:5, SEQ ID NO:8, SEQ ID NO:1, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, and SEQ ID NO:233.

In some embodiments, the nucleic acid sequence comprises a nucleic acid sequence selected from the group consisting of: SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:49, SEQ ID NO:51, SEQ ID NO:52, SEQ ID NO:54, SEQ ID NO:55, SEQ ID NO:57, SEQ ID NO:58, SEQ ID NO:60, SEQ ID NO:61, SEQ ID NO:63, SEQ ID NO:64, SEQ ID NO:66, SEQ ID NO:67, SEQ ID NO:69, SEQ ID NO:70, SEQ ID NO:72, SEQ ID NO:73, SEQ ID NO:75, SEQ ID NO:76, SEQ ID NO:78, SEQ ID NO:79, SEQ ID NO:81, SEQ ID NO:82, SEQ ID NO:84, SEQ ID NO:85, SEQ ID NO:87, SEQ ID NO:88, SEQ ID NO:90, SEQ ID NO:91, SEQ ID NO:93, SEQ ID NO:94, SEQ ID NO:96, SEQ ID NO:97, SEQ ID NO:99, SEQ ID NO:100, SEQ ID NO:102, SEQ ID NO:103, SEQ ID NO:105, SEQ ID NO:106, SEQ ID NO:108, SEQ ID NO:109, SEQ ID NO:101, SEQ ID NO:112, SEQ ID NO:114, SEQ ID NO:115, SEQ ID NO:117, SEQ ID NO:118, SEQ ID NO:120, SEQ ID NO:121, SEQ ID NO:123, SEQ ID NO:124, SEQ ID NO:126, SEQ ID NO:127, SEQ ID NO:129, SEQ ID NO:130, SEQ ID NO:132, SEQ ID NO:133, SEQ ID NO:135, SEQ ID NO:136, SEQ ID NO:138, SEQ ID NO:139, SEQ ID NO:141, SEQ ID NO:142, SEQ ID NO:144, SEQ ID NO:145, SEQ ID NO:147, SEQ ID NO:148, SEQ ID NO:150, SEQ ID NO:151, SEQ ID NO:153, SEQ ID NO:154, SEQ ID NO:156, SEQ ID NO:157, SEQ ID NO:159, SEQ ID NO:160, SEQ ID NO:162, SEQ ID NO:163, SEQ ID NO:165, SEQ ID NO:166, SEQ ID NO:168, SEQ ID NO:169, SEQ ID NO:171, SEQ ID NO:172, SEQ ID NO:174, SEQ ID NO:175, SEQ ID NO:177, SEQ ID NO:178, SEQ ID NO:180, SEQ ID NO:181, SEQ ID NO:183, SEQ ID NO:184, SEQ ID NO:186, SEQ ID NO:187, SEQ ID NO:189, SEQ ID NO:190, SEQ ID NO:192, SEQ ID NO:193, SEQ ID NO:195, SEQ ID NO:196, SEQ ID NO:198, SEQ ID NO:199, SEQ ID NO:201, SEQ ID NO:202, SEQ ID NO:204, SEQ ID NO:205, SEQ ID NO:207, SEQ ID NO:208, SEQ ID NO:210, SEQ ID NO:211, SEQ ID NO:213, SEQ ID NO:214, SEQ ID NO:216, SEQ ID NO:217, SEQ ID NO:219, SEQ ID NO:220, SEQ ID NO:222, SEQ ID NO:223, SEQ ID NO:225, SEQ ID NO:226, SEQ ID NO:228, SEQ ID NO:229, SEQ ID NO:231, SEQ ID NO:232, and SEQ ID NO:234.

In some embodiments, the nucleic acid sequence of (a) encodes a protein comprising an amino acid sequence selected from the group consisting of: SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:95, SEQ ID NO:98, SEQ ID NO:101, SEQ ID NO:104, and SEQ ID NO:107, wherein the protein has cellulolytic enhancing activity.

In some embodiments, the present invention comprises nucleic acid sequences that are fully complementary to any of the nucleic acid sequences described above.

In some embodiments, the present invention comprises an isolated protein comprising an amino acid sequence encoded by any of the nucleic acid molecules described above.

In some embodiments, the present invention comprises an isolated fusion protein comprising an isolated protein of the present invention fused to a protein comprising an amino acid sequence that is heterologous to the isolated protein.

In some embodiments, the present invention comprises an isolated antibody or antigen binding fragment thereof that selectively binds to a protein of the present invention.

In some embodiments, the present invention comprises a kit for degrading a lignocellulosic material to fermentable sugars comprising at least one isolated protein of the present invention.

In some embodiments, the present invention comprises a detergent comprising at least one isolated protein of the present invention.

In some embodiments, the present invention comprises a composition for the degradation of a lignocellulosic material comprising at least one isolated protein of the present invention.

In some embodiments, the present invention comprises a recombinant nucleic acid molecule comprising an isolated nucleic acid molecule of the present invention, operatively linked to at least one expression control sequence. In some embodiments, the recombinant nucleic acid molecule comprises an expression vector. In some embodiments, the recombinant nucleic acid molecule comprises a targeting vector.

In some embodiments, the present invention comprises an isolated host cell transfected with a nucleic acid molecule of the present invention. In some embodiments, the host cell is a fungus. In some embodiments, the host cell is a filamentous fungus. In some embodiments, the filamentous fungus is from a genus selected from the group consisting of: *Chysosporium, Thielavia, Neurospora, Aureobasidium, Filibasidium, Piromyces, Corynascus, Cryplococcus, Acremonium, Tolypocladium, Scytalidium, Schizophyllum, Sporotrichum, Penicillium, Gibberella, Myceliophthora, Mucor, Aspergillus, Fusarium, Humicola*, and *Trichoderma*, and anamorphs and teleomorphs thereof. In some embodiments, the host cell is a bacterium.

In some embodiments, the present invention comprises an oligonucleotide consisting essentially of at least 12 consecutive nucleotides of a nucleic acid sequence selected from the group consisting of: SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:49, SEQ ID NO:51, SEQ ID NO:52, SEQ ID NO:54, SEQ ID NO:55, SEQ ID NO:57, SEQ ID NO:58, SEQ ID NO:60, SEQ ID NO:61, SEQ ID NO:63, SEQ ID NO:64, SEQ ID NO:66, SEQ ID NO:67, SEQ ID NO:69, SEQ ID NO:70, SEQ ID NO:72, SEQ ID NO:73, SEQ ID NO:75, SEQ ID NO:76, SEQ ID NO:78, SEQ ID NO:79, SEQ ID NO:81, SEQ ID NO:82, SEQ ID NO:84, SEQ ID NO:85, SEQ ID NO:87, SEQ ID NO:88, SEQ ID NO:90, SEQ ID NO:91, SEQ ID NO:93, SEQ ID NO:94, SEQ ID NO:96, SEQ ID NO:97, SEQ ID NO:99, SEQ ID NO:100, SEQ ID NO:102, SEQ ID NO:103, SEQ ID NO:105, SEQ ID NO:106, SEQ ID NO:108, SEQ ID NO:109, SEQ ID NO:111, SEQ ID NO:112, SEQ ID NO:114, SEQ ID NO:115, SEQ ID NO:117, SEQ ID NO:118, SEQ ID NO:120, SEQ ID NO:121, SEQ ID NO:123, SEQ ID NO:124, SEQ ID NO:126, SEQ ID NO:127, SEQ ID NO:129, SEQ ID NO:130, SEQ ID NO:132, SEQ ID NO:133, SEQ ID NO:135, SEQ ID NO:136, SEQ ID NO:138, SEQ ID NO:139, SEQ ID NO:141, SEQ ID NO:142, SEQ ID NO:144, SEQ ID NO:145, SEQ ID NO:147, SEQ ID NO:148, SEQ ID NO:150, SEQ ID NO:151, SEQ ID NO:153, SEQ ID NO:154, SEQ ID NO:156, SEQ ID NO:157, SEQ ID NO:159, SEQ ID NO:160, SEQ ID NO:162, SEQ ID NO:163, SEQ ID NO:165, SEQ ID NO:166, SEQ ID NO:168, SEQ ID NO:169, SEQ ID NO:171, SEQ ID NO:172, SEQ ID NO:174, SEQ ID NO:175, SEQ ID NO:177, SEQ ID NO:178, SEQ ID NO:180, SEQ ID NO:181, SEQ ID NO:183, SEQ ID NO:184, SEQ ID NO:186, SEQ ID NO:187, SEQ ID NO:189, SEQ ID NO:190, SEQ ID NO:192, SEQ ID NO:193, SEQ ID NO:195, SEQ ID NO:196, SEQ ID NO:198, SEQ ID NO:199, SEQ ID NO:201, SEQ ID NO:202, SEQ ID NO:204, SEQ ID NO:205, SEQ ID NO:207, SEQ ID NO:208, SEQ ID NO:210, SEQ ID NO:211, SEQ ID NO:213, SEQ ID NO:214, SEQ ID NO:216, SEQ ID NO:217, SEQ ID NO:219, SEQ ID NO:220, SEQ ID NO:222, SEQ ID NO:223, SEQ ID NO:225, SEQ ID NO:226, SEQ ID NO:228, SEQ ID NO:229, SEQ ID NO:231, SEQ ID NO:232, and SEQ ID NO:234 or the complement thereof.

In some embodiments, the present invention comprises a kit comprising at least one oligonucleotide of the present invention.

In some embodiments, the present invention comprises methods for producing a protein of the present invention, comprising culturing a cell that has been transfected with a nucleic acid molecule comprising a nucleic acid sequence encoding the protein, and expressing the protein with the transfected cell. In some embodiments, the present invention further comprises recovering the protein from the cell or from a culture comprising the cell.

In some embodiments, the present invention comprises a genetically modified organism comprising components suitable for degrading a lignocellulosic material to fermentable sugars, wherein the organism has been genetically modified to express at least one protein of the present invention.

In some embodiments, the genetically modified organism is a plant, alga, fungus or bacterium. In some embodiments, the fungus is yeast, mushroom or filamentous fungus. In some embodiments, the filamentous fungus is from a genus selected from the group consisting of: *Chysosporium, Thielavia, Neurospora, Aureobasidium, Filibasidium, Piromyces, Corynascus, Cryplococcus, Acremonium, Tolypocladium, Scytalidium, Schizophyllum, Sporotrichum, Penicillium, Talaromyces, Gibberella, Myceliophthora, Mucor, Aspergillus, Fusarium, Humicola*, and *Trichoderma*. In some embodiments, the filamentous fungus is selected from the group consisting of: *Trichoderma reesei, Chrysosporium lucknowense, Aspergillus japonicus, Penicillium canescens, Penicillium solitum, Penicillium funiculosum*, and *Talaromyces flavus*.

In some embodiments, the genetically modified organism has been genetically modified to express at least one additional enzyme. In some embodiments, the additional enzyme is an accessory enzyme selected from the group consisting of: cellulase, glucosidase, xylanase, xylosidase, ligninase, glucuronidase, arabinofuranosidase, arabinase, arabinogalactanase, ferulic acid esterase, lipase, pectinase, glucomannase, amylase, laminarinase, xyloglucanase, galactanase, galactosidase, glucoamylase, pectate lyase, chitosanases, exo-•-D-glucosaminidase, cellobiose dehydrogenase, and acetylxylan esterase.

In some embodiments, the genetically modified organism is a plant.

In some embodiments, the present invention comprises a recombinant enzyme isolated from a genetically modified microorganism of the present invention. In some embodiments the recombinant enzyme has been subjected to a purification step.

In some embodiments, the present invention comprises a crude fermentation product produced by culturing the cells from the genetically modified organism of the present invention, wherein the crude fermentation product contains at least one protein of the present invention.

In some embodiments, the present invention comprises a multi-enzyme composition comprising enzymes produced by a genetically modified organism of the present invention, and recovered therefrom.

In some embodiments, the present invention comprises a multi-enzyme composition comprising at least one protein of the present inventions, and at least one additional protein for degrading a lignocellulosic material or a fragment thereof that has biological activity.

In some embodiments, the multi-enzyme composition comprises at least one cellobiohydrolase, at least one xylanase, at least one endoglucanase, at least one •-glucosidase, at least one •-xylosidase, and at least one accessory enzyme.

In some embodiments, between about 50% and about 70% of the enzymes in the multi-enzyme composition are cellobiohydrolases. In some embodiments, between about 10% and about 30% of the enzymes in the composition are xylanases. In some embodiments, between about 5% and about 15% of the enzymes in the composition are endoglucanases. In some embodiments, between about 1% and about 5% of the enzymes in the composition are •-glucosidases. In some embodiments, between about 1% and about 3% of the enzymes in the composition are •-xylosidases.

In some embodiments, the multi-enzyme composition comprises about 60% cellobiohydrolases, about 20% xylanases, about 10% endoglucanases, about 3% •-glucosidases, about 2% •-xylosidases, and about 5% accessory enzymes.

In some embodiments, the xylanases are selected from the group consisting of: endoxylanases, exoxylanases, and •-xylosidases.

In some embodiments, the accessory enzymes include an enzyme selected from the group consisting of: cellulase, glucosidase, xylanase, xylosidase, ligninase, glucuronidase, arabinofuranosidase, arabinase, arabinogalactanase, ferulic acid esterase, lipase, pectinase, glucomannase, amylase, laminarinase, xyloglucanase, galactanase, galactosidase, glucoamylase, pectate lyase, chitosanase, exo-•D-glucosaminidase, cellobiose dehydrogenase, and acetylxylan esterase.

In some embodiments, the multi-enzyme composition comprises at least one hemicellulase. In some embodiments, the hemicellulase is selected from the group consisting of a xylanase, an arabinofuranosidase, an acetyl xylan esterase, a glucuronidase, and endo-galactanase, a mannanase, an endo arabinase, an exo arabinase, an exo-galactanase, a ferulic acid esterase, a galactomannanase, a xylogluconase, and mixtures thereof. In some embodiments, the xylanase is selected from the group consisting of endoxylanases, exoxylanase, and β-xylosidase.

In some embodiments, the multi-enzyme composition comprises at least one cellulase.

In some embodiments, the composition is a crude fermentation product. In some embodiments, the composition is a crude fermentation product that has been subjected to a purification step.

In some embodiments, the multi-enzyme composition further comprises one or more accessory enzymes. In some embodiments, the accessory enzymes include at least one enzyme selected from the group consisting of: cellulase, glucosidase, xylanase, xylosidase, ligninase, glucuronidase, arabinofuranosidase, arabinase, arabinogalactanase, ferulic acid esterase, lipase, pectinase, glucomannase, amylase, laminarinase, xyloglucanase, galactanase, galactosidase, glucoamylase, pectate lyase, chitosanase, exo-•-D-glucosaminidase, cellobiose dehydrogenase, and acetylxylan esterase. In some embodiments, the accessory enzyme is selected from the group consisting of a glucoamylase, a pectinase, and a ligninase. In some embodiments, the accessory enzyme is added as a crude or a semi-purified enzyme mixture. In some embodiments, the accessory enzyme is produced by culturing at least one organism on a substrate to produce the enzyme.

In some embodiments, the multi-enzyme composition comprises at least one protein of the present invention, and at least one additional protein for degrading an arabinoxylan-containing material or a fragment thereof that has biological activity.

In some embodiments, the composition comprises at least one endoxylanase, at least one •-xylosidase, and at least one arabinofuranosidase. In some embodiments, the arabinofuranosidase comprises an arabinofuranosidase with specificity towards single substituted xylose residues, an arabinofuranosidase with specificity towards double substituted xylose residues, or a combination thereof.

In some embodiments, the present invention comprises methods for degrading a lignocellulosic material to fermentable sugars, comprising contacting the lignocellulosic material with at least one isolated protein of the present invention.

In some embodiments, the methods of the present invention further comprise contacting the lignocellulosic material with at least one additional isolated protein comprising an amino acid sequence that is at least about 95% identical to an amino acid sequence selected from the group consisting of: SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:95, SEQ ID NO:98, SEQ ID NO:101, SEQ ID NO:104, and SEQ ID NO:107, wherein the at least one additional protein has cellulolytic enhancing activity.

In some embodiments, the additional isolated protein is part of a multi-enzyme composition.

In some embodiments, the present invention comprises methods for degrading a lignocellulosic material to fermentable sugars, comprising contacting the lignocellulosic material with at least one multi-enzyme composition of the present invention.

In some embodiments, the present invention comprises a method for producing an organic substance, comprising:
a) saccharifying a lignocellulosic material with a multi-enzyme composition of the present invention;
b) fermenting the saccharified lignocellulosic material obtained with one or more fermentating microorganisms; and
c) recovering the organic substance from the fermentation.

In some embodiments, the steps of saccharifying and fermenting are performed simultaneously.

In some embodiments, the organic substance is an alcohol, organic acid, ketone, amino acid, or gas. In some embodiments, the alcohol is ethanol.

In some embodiments, the lignocellulosic material is selected from the group consisting of herbaceous material, agricultural residue, forestry residue, municipal solid waste, waste paper, and pulp and paper mill residue.

In some embodiments, the lignocellulosic material is distiller's dried grains (DDG) or DDG with solubles. In some embodiments, the DDG or DDG with solubles is derived from corn.

In some embodiments, the present invention comprises a method for degrading a lignocellulosic material consisting of DDG or DDG with solubles to sugars, the method comprising contacting the DDG or DDG with solubles with a multi-enzyme composition of the present invention, whereby at least about 10% of the fermentable sugars are liberated. In some embodiments, at least about 15%, at least 20%, or at least about 23% of the sugars are liberated.

In some embodiments, the present invention further comprises a pretreatment process for pretreating the lignocellulosic material.

In some embodiments, the pretreatment process is selected from the group consisting of physical treatment, metal ion, ultraviolet light, ozone, organosolv treatment, steam explosion treatment, lime impregnation with steam explosion treatment, hydrogen peroxide treatment, hydrogen peroxide/ozone (peroxone) treatment, acid treatment, dilute acid treatment, and base treatment. In some embodiments, the pretreatment process is selected from the group consisting of organosolv, steam explosion, heat treatment and AFEX. In some embodiments, the heat treatment comprises heating the lignocellulosic material to 121° C. for 15 minutes.

In some embodiments, the present invention further comprises detoxifying the lignocellulosic material.

In some embodiments, the present invention further comprises recovering the fermentable sugar.

In some embodiments, the sugar is selected from the group consisting of glucose, xylose, arabinose, galactose, mannose, rhamnose, sucrose and fructose.

In some embodiments, the present invention further comprises recovering the contacted lignocellulosic material after the fermentable sugars are degraded.

In some embodiments, the present invention comprises a feed additive comprising the recovered lignocellulosic material of the present invention. In some embodiments, the protein content of the recovered lignocellulosic material is higher than that of the starting lignocellulosic material.

In some embodiments, the present invention comprises methods of improving the performance of an animal which comprises administering to the animal the feed additive of the present invention.

In some embodiments, the present invention comprises methods for improving the nutritional quality of an animal feed comprising adding the feed additive of the present invention to an animal feed.

In some embodiments, the present invention comprises methods for stonewashing a fabric, comprising contacting the fabric with at least one isolated protein of the present invention.

In some embodiments, the present invention comprises methods for stonewashing a fabric, comprising contacting the fabric with at least one multi-enzyme composition of the present invention.

In some embodiments, the fabric is denim.

In some embodiments, the present invention comprises methods for enhancing the softness or feel of a fabric or depilling a fabric, comprising contacting the fabric with at least one isolated protein of the present invention, or a fragment thereof comprising a cellulose binding module (CBM) of the protein.

In some embodiments, the present invention comprises methods for enhancing the softness or feel of a fabric or depilling a fabric, comprising contacting the fabric with at least one multi-enzyme composition of the present invention.

In some embodiments, the present invention comprises methods for restoring color to or brightening a fabric, comprising contacting the fabric with at least one isolated protein of the present invention.

In some embodiments, the present invention comprises methods for restoring color to or brightening a fabric, comprising contacting the fabric with at least one multi-enzyme composition of the present invention.

In some embodiments, the present invention comprises methods of biopolishing, defibrillating, bleaching, dyeing or desizing a fabric, comprising contacting the fabric with at least one isolated protein of the present invention.

In some embodiments, the present invention comprises methods of biopolishing, defibrillating, bleaching, dyeing or desizing a fabric, comprising contacting the fabric with at least one multi-enzyme composition of the present invention.

In some embodiments, the present invention comprises methods of biorefining, deinking or biobleaching paper or pulp, comprising contacting the paper or pulp with at least one isolated protein of the present invention.

In some embodiments, the present invention comprises methods of biorefining, deinking or biobleaching paper or pulp, comprising contacting the paper or pulp with at least one multi-enzyme composition of the present invention In some embodiments, the present invention comprises methods for enhancing the cleaning ability of a detergent composition, comprising adding at least one isolated protein of the present invention to the detergent composition.

In some embodiments, the present invention comprises methods for enhancing the cleaning ability of a detergent composition, comprising adding at least one multi-enzyme composition of the present invention to the detergent composition.

In some embodiments, the present invention comprises a detergent composition, comprising at least one isolated protein of the present invention and at least one surfactant.

In some embodiments, the present invention comprises a detergent composition, comprising at least one multi-enzyme composition of the present invention and at least one surfactant.

In some embodiments, the present invention comprises methods for inhibiting or reducing fungal growth, comprising contacting a fungus or an area susceptible to fungal growth with an isolated protein comprising an amino acid sequence that is at least about 95% identical to the amino acid sequence of SEQ ID NO:188.

In some embodiments, the present invention comprises methods for reducing or preventing insect infestation on a plant, comprising contacting the plant with an isolated protein comprising an amino acid sequence that is at least about 95% identical to the amino acid sequence of SEQ ID NO:188.

In some embodiments, the present invention comprises methods for reducing or preventing allergic inflammation or asthma, comprising administering an isolated protein comprising an amino acid sequence that is at least about 95% identical to the amino acid sequence of SEQ ID NO:188.

In some embodiments, the present invention comprises a lysing enzyme for the generation of protoplasts from fungi, comprising an isolated protein comprising an amino acid sequence that is at least about 95% identical to the amino acid sequence of SEQ ID NO:188.

In some embodiments, the present invention comprises an insecticide composition, comprising an isolated protein comprising an amino acid sequence that is at least 95% identical to the amino acid sequence of SEQ ID NO:188.

In some embodiments, the present invention comprises methods for releasing cellular contents comprising contacting a cell with at least one protein of the present invention.

In some embodiments, the cell may be a bacterium, an algal cell, a fungal cell or a plant cell. In preferred embodiments, the cell is an algal cell.

In some embodiments, contacting the cell with at least one protein of the present invention degrades the cell wall.

In some embodiments, the cellular contents are selected from the group consisting of: alcohols and oils.

In some embodiments, the present invention comprises compositions for degrading cell walls comprising at least one protein of the present invention.

In some embodiments, the present invention comprises methods for improving the nutritional quality of food comprising adding to the food at least one protein of the present invention.

In some embodiments, the present invention comprises methods for improving the nutritional quality of food comprising pretreating the food with at least one protein of the present invention.

In some embodiments, the present invention comprises methods for improving the nutritional quality of animal feed comprising adding to the animal feed at least one protein of the present invention.

In some embodiments, the present invention comprises methods for improving the nutritional quality of animal feed comprising pretreating the feed with at least one isolated protein of the present invention.

In some embodiments, the present invention comprises a genetically modified organism comprising at least one nucleic acid molecule encoding a protein of the present invention, in which the activity of one or more of the proteins is upregulated, the activity of one or more of the proteins downregulated, or the activity of one or more of the proteins is upregulated and the activity of one or more of the proteins is downregulated.

DETAILED DESCRIPTION OF THE INVENTION

Figure 1:
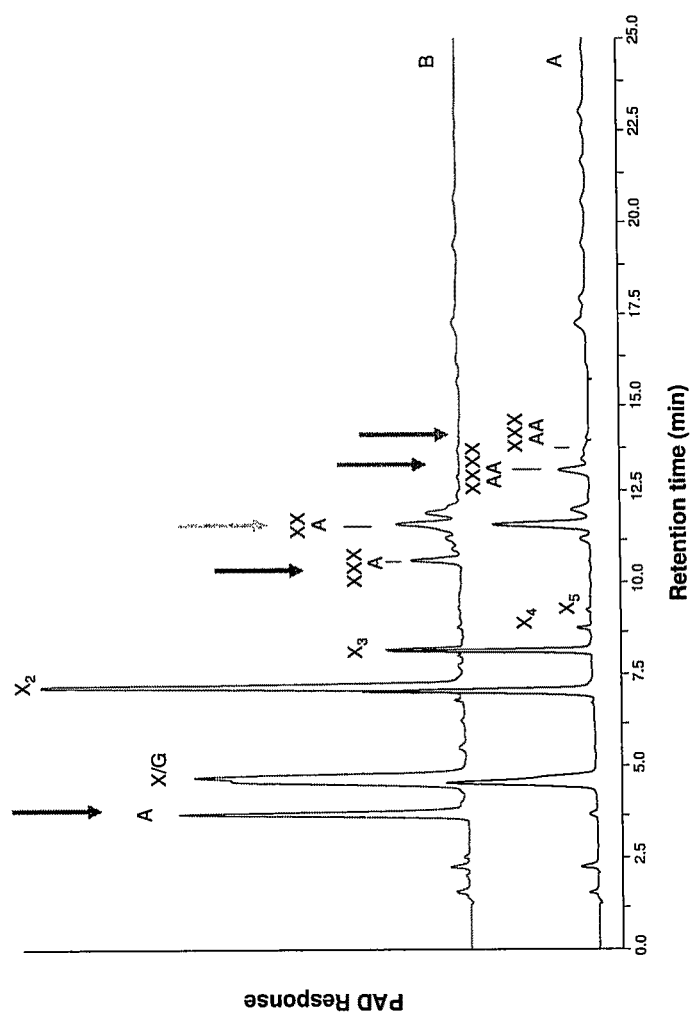
FIG. 1 shows HPAEC diagrams of wheat arabinoxylan (WAX) incubated with the enzyme Pentopan (A), and WAX incubated with Pentopan followed by Abn7 (B). A indicates arabinose, while X indicates xylose.

The present invention relates generally to proteins that play a role in the degradation of cellulose and hemicellulose and nucleic acids encoding the same. In particular, the present invention relates to enzymes isolated from a filamentous fungal strain denoted herein as C1 (Accession No. VKM F-3500-D), nucleic acids encoding the enzymes, and methods of producing and using the enzymes. The invention also provides compositions that include at least one of the enzymes described herein for uses including, but not limited to, the hydrolysis of lignocellulose. The invention stems, in part, from the discovery of a variety of novel cellulases and hemicellulases produced by the C1 fungus that exhibit high activity toward cellulose and other components of biomass.

The present invention also provides methods and compositions for the conversion of plant biomass to fermentable sugars that can be converted to useful products. Such products may include, without limitation, bioplastics, biopolymers and biofuels. The methods include methods for degrading lignocellulosic material using enzyme mixtures to liberate sugars. The compositions of the invention include enzyme combinations that break down lignocellulose. As used herein the terms "biomass" or "lignocellulosic material" includes materials containing cellulose and/or hemicellulose. Generally, these materials also contain pectin, lignin, protein, carbohydrates (such as starch and sugar) and ash. Lignocellulose is generally found, for example, in the stems, leaves, hulls, husks, and cobs of plants or leaves, branches, and wood of trees. The process of converting a complex carbohydrate (such as starch or cellulose) into fermentable sugars is also referred to herein as "saccharification." Fermentable sugars, as used herein, refers to simple sugars, such as glucose, xylose, arabinose, galactose, mannose, rhamnose, sucrose and fructose.

Biomass can include virgin biomass and/or non-virgin biomass such as agricultural biomass, commercial organics, construction and demolition debris, municipal solid waste, waste paper and yard waste. Common forms of biomass include trees, shrubs and grasses, wheat, wheat straw, sugar cane bagasse, corn, corn husks, corn kernel including fiber from kernels, products and by-products from milling of grains such as corn, wheat and barley (including wet milling and dry milling) as well as municipal solid waste, waste paper and yard waste. The biomass can also be, but is not limited to, herbaceous material, agricultural residues, forestry residues, municipal solid wastes, waste paper, and pulp and paper mill residues. "Agricultural biomass" includes branches, bushes, canes, corn and corn husks, energy crops, algae, fruits, flowers, grains, grasses, herbaceous crops, leaves, bark, needles, logs, roots, saplings, short rotation woody crops, shrubs, switch grasses, trees, vegetables, fruit peels, vines, sugar beet pulp, wheat midlings, oat hulls, peat moss, mushroom compost and hard and soft woods (not including woods with deleterious materials). In addition, agricultural biomass includes organic waste materials generated from agricultural processes including farming and forestry activities, specifically including forestry wood waste. Agricultural biomass may be any of the aforestated singularly or in any combination or mixture thereof.

Energy crops are fast-growing crops that are grown for the specific purpose of producing energy, including without limitation, biofuels, from all or part of the plant. Energy crops can include crops that are grown (or are designed to grow) for their increased cellulose, xylose and sugar contents. Examples of such plants include, without limitation, switchgrass, willow and poplar. Energy crops may also include algae, for example, designer algae that are genetically engineered for enhanced production of hydrogen, alcohols, and oils, which can be further processed into diesel and jet fuels, as well as other bio-based products.

Biomass high in starch, sugar, or protein such as corn, grains, fruits and vegetables are usually consumed as food. Conversely, biomass high in cellulose, hemicellulose and lignin are not readily digestible and are primarily utilized for wood and paper products, animal feed, fuel, or are typically disposed. Generally, the substrate is of high lignocellulose content, including distillers' dried grains corn stover, corn cobs, rice straw, wheat straw, hay, sugarcane bagasse, sugar cane pulp, citrus peels and other agricultural biomass, switchgrass, forestry wastes, poplar wood chips, pine wood chips, sawdust, yard waste, and the like, including any combination thereof.

In one embodiment, the lignocellulosic material is distillers' dried grains (DDG). DDG (also known as dried distiller's grain, or distiller's spent grain) is spent, dried grains recovered after alcohol fermentation. The lignocellulosic material can also be distiller's dried grain with soluble material recycled back (DDGS). While reference will be made herein to DDG for convenience and simplicity, it should be understood that both DDG and DDGS are contemplated as desired lignocellulosic materials. These are largely considered to be waste products and can be obtained after the fermentation of the starch derived from any of a number of grains, including corn, wheat, barley, oats, rice and rye. In one embodiment the DDG is derived from corn.

It should be noted that the distiller's grains do not necessarily have to be dried. Although the grains normally, currently dried, water and enzymes are added to the DDG substrate in the present invention. If the saccharification were done on site, the drying step could be eliminated and enzymes could be added to the distiller's grains without drying.

Due in part to the many components that comprise biomass and lignocellulosic materials, enzymes or a mixture of enzymes capable of degrading xylan, lignin, protein, and carbohydrates are needed to achieve saccharification. The present invention includes enzymes or compositions thereof with, for example, cellobiohydrolase, endoglucanase, xylanase, β-glucosidase, and hemicellulase activities.

The enzymes of the present invention may also be used for stone washing cellulosic fabrics such as cotton (e.g., denim), linen, hemp, ramie, cupro, lyocell, newcell, rayon and the like. See, for example, U.S. Pat. No. 6,015,707. The enzymes and compositions of the present invention are suitable for industrial textile applications in addition to the stone washing process. For example, cellulases are used in detergent compositions, either for the purpose of enhancing the cleaning ability of the composition or as a softening agent. When so used, the cellulase will degrade a portion of the cellulosic material, e.g., cotton fabric, in the wash, which facilitates the cleaning and/or softening of the fabric. The endoglucanase components of fungal cellulases have also been used for the purposes of enhancing the cleaning ability of detergent compositions, for use as a softening agent, and for use in improving the feel of cotton fabrics, and the like. Enzymes and compositions of the present invention may also be used in the treatment of paper pulp (e.g., for improving the drainage or for de-inking of recycled paper) or for the treatment of wastewater streams (e.g., to hydrolyze waste material containing cellulose, hemicellulose and pectins to soluble lower molecular weight polymers).

The enzymes of the present invention may also be used to release the contents of a cell. In some embodiments, contacting or mixing the cells with the enzymes of the present invention will degrade the cell walls, resulting in cell lysis and release of the cellular contents. Such cells can include bacteria, plant cells, fungi, and algae. For example, the enzymes of the present invention may be used to degrade the cell walls of algal cells in order to release the materials contained within the algal cells. In some embodiments, such materials may include, without limitation, alcohols and oils. The alcohols and oils so released can be further processed to produce diesel, jet fuels, as well as other economically important bio-products.

The enzymes of the present invention may be used alone, or in combination with other enzymes, chemicals or biological materials. The enzymes of the present invention may be used for in vitro applications in which the enzymes or mixtures thereof are added to or mixed with the appropriate substrates to catalyze the desired reactions. Additionally, the enzymes of the present invention may be used for in vivo applications in which nucleic acid molecules encoding the enzymes are introduced into cells and are expressed therein to produce the enzymes and catalyze the desired reactions within the cells. For example, in some embodiments, enzymes capable of promoting cell wall degradation may be added to algal cells suspended in solutions to degrade the algal cell walls and release their content, whereas in some embodiments, nucleic acid molecules encoding such enzymes may be introduced into the algal cells to express the enzymes therein, so that these enzymes can degrade the algal cell walls from within. Some embodiments may combine the in vitro applications with the in vivo applications. For example, nucleic acids encoding enzymes capable of catalyzing cell wall degradation may be introduced into algal cells to express the enzymes in those cells and to degrade their cell walls, while enzymes may also added to or mixed with the cells to further promote the cell wall degradation. In some embodiments, the enzymes used for in vitro applications may be different from the enzymes used for in vivo applications. For example, an enzyme with the laminarinase activity may be mixed with the cells, while an enzyme with the xyloglucanase activity is expressed within the cells.

In one aspect, the present invention includes proteins isolated from, or derived from the knowledge of enzymes from, a fungus such as *C. lucknowense* or a mutant or other derivative thereof, and more particularly, from the fungal strain denoted herein as C1 (Accession No. VKM F-3500-D). Preferably, the proteins of the invention possess enzymatic activity. As described in U.S. Pat. No. 6,015,707 or U.S. Pat. No.

6,573,086, each of which is incorporated herein by reference for all purposes, a strain called C1 (Accession No. VKM F-3500-D), was isolated from samples of forest alkaline soil from Sola Lake, Far East of the Russian Federation. This strain was deposited at the All-Russian Collection of Microorganisms of Russian Academy of Sciences (VKM), Bakhurhina St. 8, Moscow, Russia, 113184, under the terms of the Budapest Treaty on the International Regulation of the Deposit of Microorganisms for the Purposes of Patent Procedure on Aug. 29, 1996, as Chrysosporium lucknowense Garg 27K, VKM-F 3500 D. Various mutant strains of C. lucknowense C1 have been produced and these strains have also been deposited at the All-Russian Collection of Microorganisms of Russian Academy of Sciences (VKM), Bakhurhina St. 8, Moscow, Russia, 113184, under the terms of the Budapest Treaty on the International Regulation of the Deposit of Microorganisms for the Purposes of Patent Procedure on Sep. 2, 1998. For example, Strain C1 was mutagenised by subjecting it to ultraviolet light to generate strain UV13-6 (Accession No. VKM F-3632 D). This strain was subsequently further mutated with N-methyl-N'-nitro-N-nitrosoguanidine to generate strain NG7C-19 (Accession No. VKM F-3633 D). This latter strain in turn was subjected to mutation by ultraviolet light, resulting in strain UV18-25 (VKM F-3631 D). Strain C1 was classified as a Chrysosporium lucknowense based on morphological and growth characteristics of the microorganism, as discussed in detail in U.S. Pat. No. 6,015,707 and U.S. Pat. No. 6,573,086.

In certain embodiments of the present invention, a protein of the invention comprises, consists essentially of, or consists of an amino acid sequence selected from: SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233. The present invention also includes homologues of any of the above sequences, including fragments and sequences having a given identity to any of the above sequences, wherein the homologue or fragment has at least one biological activity of the wild-type protein, as described herein.

In general, the proteins disclosed herein possess carbohydrase enzymatic activity, or the ability to degrade carbohydrate-containing materials. A review of enzymes involved in the degradation of polysaccharides can be found in de Vries et al., Microbiol. Mol. Biol. Rev. 65:497-522 (2001). More specifically, the proteins may possess cellulase activity such as endoglucanase activity (e.g., 1,4-β-D-glucan-4-glucanohydrolases), exoglucanase activity (e.g., 1,4-β-D-glucan cellobiohydrolases), and β-glucosidase activity. The proteins may possess hemicellulase activity such as endoxylanase activity, exoxylanase activity, or β-xylosidase activity. The proteins may possess laminarinase, xyloglucanase, galactanase, glucoamylase, pectate lyase, chitosanase, exo-β-D-glucosaminidase, cellobiose dehydrogenase, acetylxylan esterase, ligninase, amylase, glucuronidase, ferulic acid esterase, arabinofuranosidase, pectin methyl esterase, arabinase, lipase, glucosidase, β-hexosaminidase, rhamnogalacturonan acetylesterase, exo-rhamnogalacturonase, rhamnogalacturonan lyase, exo-polygalacturonase, lichenase, pectate lyase, β-mannanase, mannan endo 1,6-α-mannosidase, or glucomannanase activities. Physical properties, biochemical characteristics and substrate specificities of proteins of the present invention are illustrated below.

As used herein, "carbohydrase" refers to any protein that catalyzes the hydrolysis of carbohydrates. "Glycoside hydrolase", "glycosyl hydrolase" or "glycosidase" refers to a protein that catalyzes the hydrolysis of the glycosidic bonds between carbohydrates or between a carbohydrate and a non-carbohydrate residue. Endoglucanases, cellobiohydrolases, β-glucosidases, α-glucosidases, xylanases, β-xylosidases, galactanases, α-galactosidases, β-galactosidases, α-amylases, glucoamylases, endo-arabinases, arabinofuranosidases, mannanases, β-mannosidases, pectinases, acetyl xylan esterases, acetyl mannan esterases, ferulic acid esterases, coumaric acid esterases, pectin methyl esterases, and chitosanases are examples of glycosidases.

"Cellulase" refers to a protein that catalyzes the hydrolysis of 1,4-β-D-glycosidic linkages in cellulose (such as bacterial cellulose, cotton, filter paper, phosphoric acid swollen cellulose, Avicel); cellulose derivatives (such as carboxymethylcellulose and hydroxyethylcellulose); plant lignocellulosic materials, beta-D-glucans or xyloglucans. Cellulose is a linear beta-(1-4) glucan consisting of anhydrocellobiose units. Endoglucanases, cellobiohydrolases, and β-glucosidases are examples of cellulases. "Endoglucanase" refers to a protein that catalyzes the hydrolysis of cellulose to oligosaccharide chains at random locations by means of an endoglucanase activity. "Cellobiohydrolase" refers to a protein that catalyzes the hydrolysis of cellulose to cellobiose via an exoglucanase activity, sequentially releasing molecules of cellobiose from the reducing or non-reducing ends of cellulose or cello-oligosaccharides. "β-glucosidase" refers to an enzyme that catalyzes the conversion of cellobiose and oligosaccharides to glucose.

"Hemicellulase" refers to a protein that catalyzes the hydrolysis of hemicellulose, such as that found in lignocellulosic materials. Hemicellulose is a complex polymer, and its composition often varies widely from organism to organism, and from one tissue type to another. Hemicelluloses include a variety of compounds, such as xylans, arabinoxylans, xyloglucans, mannans, glucomannans, and galactomannans. Hemicellulose can also contain glucan, which is a general term for beta-linked glucose residues. In general, a main component of hemicellulose is beta-1,4-linked xylose, a five carbon sugar. However, this xylose is often branched as beta-1,3 linkages or beta-1,2 linkages, and can be substituted with linkages to arabinose, galactose, mannose, glucuronic acid, or by esterification to acetic acid. The composition, nature of substitution, and degree of branching of hemicellulose is very different in dicotyledonous plants (dicots, i.e., plant whose seeds have two cotyledons or seed leaves such as lima beans, peanuts, almonds, peas, kidney beans) as compared to monocotyledonous plants (monocots; i.e., plants having a single cotyledon or seed leaf such as corn, wheat, rice, grasses, barley). In dicots, hemicellulose is comprised mainly of xyloglucans that are 1,4-beta-linked glucose chains with 1,6-alpha-linked xylosyl side chains. In monocots, including most grain crops, the principal components of hemicellulose are heteroxylans. These are primarily comprised of 1,4-beta-linked xylose backbone polymers with 1,2- or 1,3-beta linkages to arabinose, galactose and mannose as well as xylose modified by ester-linked acetic acids. Also present are branched beta glucans comprised of 1,3- and 1,4-beta-linked glucosyl chains. In monocots, cellulose, heteroxylans and beta glucans are present in roughly equal amounts, each comprising about 15-25% of the dry matter of cell walls. Hemicellulolytic enzymes, i.e. hemicellulases, include both endo-acting and exo-acting enzymes, such as xylanases, β-xylosidases. galactanases, α-galactosidases, β-galactosidases, endo-arabinases, arabinofuranosidases, mannanases, β-mannosidases. Hemicellulases also include the accessory enzymes, such as acetylesterases, ferulic acid esterases, and coumaric acid esterases. Among these, xylanases and acetyl xylan esterases cleave the xylan and acetyl side chains of xylan and the remaining xylo-oligomers are unsubstituted and can thus be hydrolysed with β-xylosidase only. In addition, several less known side activities have been found in enzyme preparations which hydrolyze hemicellulose. Accordingly, xylanases, acetylesterases and β-xylosidases are examples of hemicellulases.

"Xylanase" specifically refers to an enzyme that hydrolyzes the β-1,4 bond in the xylan backbone, producing short xylooligosaccharides.

"β-Mannanase" or "endo-1,4-β-mannosidase" refers to a protein that hydrolyzes mannan-based hemicelluloses (mannan, glucomannan, galactomannan) and produces short β-1,4-mannooligosaccharides.

"Mannan endo-1,6-α-mannosidase" refers to a protein that hydrolyzes 1,6-αmannosidic linkages in unbranched 1,6-mannans.

"•-Mannosidase" (•-1,4-mannoside mannohydrolase; EC 3.2.1.25) refers to a protein that catalyzes the removal of •-D-mannose residues from the nonreducing ends of oligosaccharides.

"Galactanase", "endo-β-1,6-galactanse" or "arabinogalactan endo-1,4-β-galactosidase" refers to a protein that catalyzes the hydrolysis of endo-1,4-β-D-galactosidic linkages in arabinogalactans.

"Glucoamylase" refers to a protein that catalyzes the hydrolysis of terminal 1,4-linked α-D-glucose residues successively from non-reducing ends of the chains with the release of β-D-glucose.

"β-hexosaminidase" or "β-N-acetylglucosaminidase" refers to a protein that catalyzes the hydrolysis of terminal N-acetyl-D-hexosamine residues in N-acetyl-β-D-hexosaminides.

"α-L-arabinofuranosidase", "α-N-arabinofuranosidase", "α-arabinofuranosidase", "arabinosidase" or "arabinofuranosidase" refers to a protein that hydrolyzes arabinofuranosyl-containing hemicelluloses. Some of these enzymes remove arabinofuranoside residues from O-2 or O-3 single substituted xylose residues, as well as from O-2 and/or O-3 double substituted xylose residues.

"Endo-arabinase" refers to a protein that catalyzes the hydrolysis of 1,5-α-arabinofuranosidic linkages in 1,5-arabinans.

"Exo-arabinase" refers to a protein that catalyzes the hydrolysis of 1,5-•-linkages in 1,5-arabinans or 1,5-•-L arabino-oligosaccharides, releasing mainly arabinobiose, although a small amount of arabinotriose can also be liberated.

"β-xylosidase" refers to a protein that hydrolyzes short 1,4-O-D-xylooligomers into xylose.

"Cellobiose dehydrogenase" refers to a protein that oxidizes cellobiose to cellobionolactone.

"Chitosanase" refers to a protein that catalyzes the endohydrolysis of β-1,4-linkages between D-glucosamine residues in acetylated chitosan (i.e., deacetylated chitin).

"Exo-polygalacturonase" refers to a protein that catalyzes the conversion of polygalacturonides to galacturonic acid.

"Acetyl xylan esterase" refers to a protein that catalyzes the removal of the acetyl groups from xylose residues. "Acetyl mannan esterase" refers to a protein that catalyzes the removal of the acetyl groups from mannose residues. "ferulic esterase" or "ferulic acid esterase" refers to a protein that hydrolyzes the ester bond between the arabinose substituent group and ferulic acid. "Coumaric acid esterase" refers to a protein that hydrolyzes the ester bond between the arabinose substituent group and coumaric acid. Acetyl xylan esterases, ferulic acid esterases and pectin methyl esterases are examples of carbohydrate esterases.

"Pectate lyase" refers to a protein that catalyzes the cleavage of 1,4-α-D-galacturonan in oligosaccharide substrates.

"Endo-1,3-β-glucanase" or "laminarinase" refers to a protein that catalyzes the cleavage of 1,3-linkages in •-D-glucans such as laminarin or lichenin. Laminarin is a linear polysaccharide made up of β-1,3-glucan with β-1,6-linkages.

"Lichenase" refers to a protein that catalyzes the hydrolysis of lichenan, a linear, 1,3-1,4-β-D glucan.

Rhamnogalacturonan is composed of alternating α-1,4-rhamnose and α-1,2-linked galacturonic acid, with side chains linked 1,4 to rhamnose. The side chains include Type I galactan, which is β-1,4-linked galactose with α-1,3-linked arabinose substituents; Type II galactan, which is β-1,3-1,6-linked galactoses (very branched) with arabinose substituents; and arabinan, which is α-1,5-linked arabinose with α-1,3-linked arabinose branches. The galacturonic acid substituents may be acetylated and/or methylated.

"Exo-rhamnogalacturonanase" refers to a protein that catalyzes the degradation of the rhamnogalacturonan backbone of pectin from the nonreducing end.

"Rhamnogalacturonan acetylesterase" refers to a protein that catalyzes the removal of the acetyl groups ester-linked to the highly branched rhamnogalacturonan (hairy) regions of pectin.

"Rhamnogalacturonan lyase" refers to a protein that catalyzes the degradation of the rhamnogalacturonan backbone of pectin via a β-elimination mechanism (see, e.g., Pages et al., *J. Bacteriol.* 185:4727-4733 (2003)).

Glycosidases (glycoside hydrolases; GH), a large family of enzymes that includes cellulases and hemicellulases, catalyze the hydrolysis of glycosidic linkages, predominantly in carbohydrates. Glycosidases such as the proteins of the present invention may be assigned to families on the basis of sequence similarities, and there are now over 100 different such families defined (see the CAZy (Carbohydrate Active EnZymes database) website, maintained by the Architecture of Fonction de Macromolecules Biologiques of the Centre National de la Recherche Scientifique, which describes the families of structurally-related catalytic and carbohydrate-binding modules (or functional domains) of enzymes that degrade, modify, or create glycosidic bonds; Coutinho, P. M. & Henrissat, B. (1999) Carbohydrate-active enzymes: an integrated database approach. In "Recent Advances in Carbohydrate Bioengineering", H. J. Gilbert, G. Davies, B. Henrissat and B. Svensson eds., The Royal Society of Chemistry, Cambridge, pp. 3-12). Because there is a direct relationship between the amino acid sequence of a protein and its folding similarities, such a classification reflects the structural features of these enzymes and their substrate specificity. Such a classification system can help to reveal the evolutionary relationships between these enzymes and provide a convenient tool to determine information such as an enzyme's activity and function. Thus, enzymes assigned to a particular family based on sequence homology with other members of the family are expected to have similar enzymatic activities and related substrate specificities. CAZy family classifications also exist for glycosyltransferases (GT), polysaccharide lyases (PL), and carbohydrate esterases (CE). Likewise, sequence homology may be used to identify particular domains within proteins, such as cellulose binding modules (CBMs; also known as cellulose binding domains (CBDs)). The CAZy homologies of proteins of the present invention are disclosed below. An enzyme assigned to a particular CAZy family may exhibit one or more of the enzymatic activities or substrate specificities associated with the CAZy family. In other embodiments, the enzymes of the present invention may exhibit one or more of the enzyme activities discussed above.

Certain proteins of the present invention may be classified as "Family 61 glycosidases" based on homology of the polypeptides to CAZy Family GH61. Family 61 glycosidases may exhibit cellulolytic enhancing activity or endoglucanase activity. Additional information on the properties of Family 61 glycosidases may be found in U.S. Patent Application Publication Nos. 2005/0191736, 2006/0005279, 2007/0077630, and in PCT Publication No. WO 2004/031378.

As used herein, "cellulolytic enhancing activity" refers to a biological activity that enhances the hydrolysis of a cellulosic material by proteins having cellulolytic activity. In other words, saccharifying a cellulosic material with a cellulolytic protein in the presence of a Family 61 glycosidases may increase the degradation of cellulosic material compared to the presence of only the cellulolytic protein. The cellulosic material can be any material containing cellulose. The cellulolytic activity is a biological activity that hydrolyzes a cellulosic material. Cellulolytic enhancing activity can be determined by measuring the increase in sugars from the hydrolysis of a cellulosic material by cellulolytic protein.

Proteins of the present invention may also include homologues and fragments of the proteins disclosed herein. The protein fragments include, but are not limited to, fragments comprising a catalytic domain (CD) and/or a cellulose-binding domain (also known as a cellulose binding module (CBM); both are referred to herein as CBM). The identity and location of domains within proteins of the present invention are disclosed in detail below. The present invention encompasses all combinations of the disclosed domains. For example, a protein fragment may comprise a CD of a protein but not a CBM of the protein or a CBM of a protein but not a CD. Similarly, domains from different proteins may be combined. Protein fragments comprising a CD, CBM or combinations thereof for each protein disclosed herein can be readily produced using standard techniques known in the art. In some embodiments, a protein fragment comprises a domain of a protein that has at least one biological activity of the full-length protein. Homologues of proteins of the invention that have at least one biological activity of the full-length protein are described in detail below. As used herein, the phrase "biological activity" of a protein refers to any function(s) exhibited or performed by the protein that is ascribed to the naturally occurring form of the protein as measured or observed in vitro or in vivo. In certain embodiments, a protein fragment comprises a domain of a protein that has the catalytic activity of the full-length enzyme. Specific biological activities of the proteins of the invention, and structures within the proteins that are responsible for the activities, are described below.

Descriptions of the enzymes of the present invention are provided below, along with activities and homologies. Although each enzyme is expected to exhibit the activity exemplified below, enzymes of the present invention may also exhibit any of the enzyme activities or substrate specificities discussed throughout this disclosure.

The enzyme CDH1 is encoded by the nucleic acid sequence represented herein as SEQ ID NO:1 and the cDNA sequence represented herein as SEQ ID NO:3. The CDH1 nucleic acid sequence encodes a 828 amino acid sequence, represented herein as SEQ ID NO:2. The signal peptide for CDH1 is located from positions 1 to about position 21 of SEQ ID NO:2, with the mature protein spanning from about position 22 to position 828 of SEQ ID NO:2. Within CDH1 are two domains: a catalytic domain (CD) and a cellulose-binding module (CBM). The amino acid sequence containing the CD of CDH1 spans from a starting point of about position 252 of SEQ ID NO:2 to an ending point of about position 780 of SEQ ID NO:2. The amino acid sequence containing the CBM of CDH1 spans from a starting point of about position 781 of SEQ ID NO:2 to an ending point of about position 817 of SEQ ID NO:2. CDH1 possesses significant homology (about 62% from amino acids 1 to 788 of CDH1) with a cellobiose dehydrogenase from *Neosartorya fischeri* NRRL 181 (Genbank Accession No. EAW19340). Based on this degree of homology, CDH1 is expected to exhibit similar cellobiose dehydrogenase enzymatic activity. Based on homology, CDH1 also contains a putative cellulose binding module assigned to CAZy Family CBM 1. As evidenced below in Example 4, CDH1 contains a carbohydrate binding module.

The enzyme FaeB1 is encoded by the nucleic acid sequence represented herein as SEQ ID NO:4 and the cDNA sequence represented herein as SEQ ID NO:6. The FaeB1 nucleic acid sequence encodes a 319 amino acid sequence, represented herein as SEQ ID NO:5. The signal peptide for FaeB1 is located from positions 1 to about position 22 of SEQ ID NO:5, with the mature protein spanning from about position 23 to position 319 of SEQ ID NO:5. Within FaeB1 is a catalytic domain (CD). The amino acid sequence containing the CD of FaeB1 spans from a starting point of about position 63 of SEQ ID NO:5 to an ending point of about position 278 of SEQ ID NO:5. FaeB1 possesses significant homology (about 67% from amino acids 46 to 319 of FaeB1) with a ferulic acid esterase from *Neurospora crassa* (Genbank Accession No. CAC05587). Based on this degree of homology, FaeB1 is expected to exhibit similar ferulic acid esterase enzymatic activity.

The enzyme Rga1 is encoded by the nucleic acid sequence represented herein as SEQ ID NO:7 and the cDNA sequence represented herein as SEQ ID NO:9. The Rga1 nucleic acid sequence encodes a 263 amino acid sequence, represented herein as SEQ ID NO:8. The signal peptide for Rga1 is located from positions 1 to about position 19 of SEQ ID NO:8, with the mature protein spanning from about position 20 to position 263 of SEQ ID NO:8. Within Rga1 is a catalytic domain (CD). The amino acid sequence containing the CD of Rga1 spans from a starting point of about position 30 of SEQ ID NO:8 to an ending point of about position 258 of SEQ ID NO:8. Based on homology, Rga1 can be assigned to CAZy Family CE 12. Rga1 also possesses significant homology (about 56% from amino acids 31 to 241 of Rga1) with a rhamnogalacturonan acetylesterase from *Aspergillus aculeatus* (Genbank Accession No. CAA61858); see also Kauppinen et al., *J. Biol. Chem.* 270:27172 (1995)). Based on this degree of homology, Rga1 is expected to exhibit similar rhamnogalacturonan acetylesterase enzymatic activity. As evidenced below in Example 10, Rga1 exhibits acetyl esterase activity.

The enzyme Gln is encoded by the nucleic acid sequence represented herein as SEQ ID NO:10 and the cDNA sequence represented herein as SEQ ID NO:12. The Gln nucleic acid sequence encodes a 482 amino acid sequence, represented herein as SEQ ID NO:11. The signal peptide for Gln is located from positions 1 to about position 22 of SEQ ID NO:11, with the mature protein spanning from about position 23 to position 482 of SEQ ID NO:11. Within Gln is a catalytic domain (CD). The amino acid sequence containing the CD of Gln spans from a starting point of about position 37 of SEQ ID NO:11 to an ending point of about position 385 of SEQ ID NO:11. Based on homology, Gln can be assigned to CAZy Family GH 5. Gln also possesses significant homology (about 57% from amino acids 6 to 482 of Gln) with an endo-β-1,6-galactanase from *Trichoderma viride* (Genbank Accession No. BAC84995; see also Kotake et al., *Biochem. J.* 377(Pt. 3):749 (2004)). Based on this degree of homology, Gln is expected to exhibit similar endo-β-1,6-galactanase enzymatic activity.

The enzyme Abn2 is encoded by the nucleic acid sequence represented herein as SEQ ID NO:13 and the cDNA sequence represented herein as SEQ ID NO:15. The Abn2 nucleic acid sequence encodes a 378 amino acid sequence, represented herein as SEQ ID NO:14. The signal peptide for Abn2 is located from positions 1 to about position 17 of SEQ ID NO:14, with the mature protein spanning from about position 18 to position 378 of SEQ ID NO:14. Within Abn2 is a catalytic domain (CD). The amino acid sequence containing the CD of Abn2 spans from a starting point of about position 78 of SEQ ID NO:14 to an ending point of about position 153 of SEQ ID NO:14. Based on homology, Abn2 can be assigned to CAZy Family GH 93. Abn2 also possesses significant homology (about 55% from amino acids 19 to 378 of Abn2) with an exo-arabinase from *Penicillium chrysogenum* (Genbank Accession No. BAC76689; see also Sakamoto et al., *FEBS Lett.* 560:199 (2004)). Based on this degree of homology, Abn2 is expected to exhibit similar exo-arabinase enzymatic activity.

The enzyme Abn3 is encoded by the nucleic acid sequence represented herein as SEQ ID NO:16 and the cDNA sequence represented herein as SEQ ID NO:18. The Abn3 nucleic acid sequence encodes a 354 amino acid sequence, represented herein as SEQ ID NO:17. The signal peptide for Abn3 is located from positions 1 to about position 25 of SEQ ID NO:17, with the mature protein spanning from about position 26 to position 354 of SEQ ID NO:17. Within Abn3 is a catalytic domain (CD). The amino acid sequence containing the CD of Abn3 spans from a starting point of about position 86 of SEQ ID NO:17 to an ending point of about position 354 of SEQ ID NO:17. Based on homology, Abn3 can be assigned to CAZy Family GH 43. Abn3 also possesses significant homology (about 49% from amino acids 41 to 351 of Abn3) with a putative arabinosidase from *Aspergillus fumigatus* (Genbank Accession No. XP_749202). Based on this degree of homology, Abn3 is expected to exhibit similar arabinosidase enzymatic activity.

The enzyme Abn4 is encoded by the nucleic acid sequence represented herein as SEQ ID NO:19 and the cDNA sequence represented herein as SEQ ID NO:21. The Abn4 nucleic acid sequence encodes a 320 amino acid sequence, represented herein as SEQ ID NO:20. The signal peptide for Abn4 is located from positions 1 to about position 19 of SEQ ID NO:20, with the mature protein spanning from about position 20 to position 320 of SEQ ID NO:20. Within Abn4 is a catalytic domain (CD). The amino acid sequence containing the CD of Abn4 spans from a starting point of about position 22 of SEQ ID NO:20 to an ending point of about position 318 of SEQ ID NO:20. Based on homology, Abn4 can be assigned to CAZy Family GH 43. As shown in Example 1 below, Abn4 exhibits •-arabinofuranosidase activity based on the ability to hydrolyze p-nitrophenyl •-L-arabinofuranoside (PNPA). As shown in Example 11, Abn4 is able to release more arabinose when incubated with branched arabinan than when incubated with linear arabinan. Abn4 also possesses significant homology (about 44% from amino acids 18 to 320 of Abn4) with an α-N-arabinofuranosidase from *Shewanella* sp. (Genbank Accession No. YP_963351). Based on this degree of homology, Abn4 is expected to exhibit similar α-arabinofuranosidase enzymatic activity.

The enzyme Abn5 is encoded by the nucleic acid sequence represented herein as SEQ ID NO:22 and the cDNA sequence represented herein as SEQ ID NO:24. The Abn5 nucleic acid sequence encodes a 451 amino acid sequence, represented herein as SEQ ID NO:23. The signal peptide for Abn5 is located from positions 1 to about position 18 of SEQ ID NO:23, with the mature protein spanning from about position 19 to position 451 of SEQ ID NO:23. Within Abn5 is a catalytic domain (CD). The amino acid sequence containing the CD of Abn5 spans from a starting point of about position 19 of SEQ ID NO:23 to an ending point of about position 312 of SEQ ID NO:23. Based on homology, Abn5 can be assigned to CAZy Families GH 43 and CBM 35. As shown in Examples 1 and 6 below, Abn5 exhibits •-arabinofuranosidase activity based on the ability to hydrolyze p-nitrophenyl •-L-arabinofuranoside (PNPA). Abn5 also possesses significant homology (about 54% from amino acids 1 to 449 of Abn5) with a glycosyl hydrolase family 43 protein from *Neosartorya fischeri* (Genbank Accession No. EAW20002). As shown in Example 11, Abn5 was able to release arabinose when incubated with linear arabinan.

The enzyme Abn7 is encoded by the nucleic acid sequence represented herein as SEQ ID NO:25 and the cDNA sequence represented herein as SEQ ID NO:27. The Abn7 nucleic acid sequence encodes a 558 amino acid sequence, represented herein as SEQ ID NO:26. The signal peptide for Abn7 is located from positions 1 to about position 23 of SEQ ID NO:26, with the mature protein spanning from about position 24 to position 558 of SEQ ID NO:26. Within Abn7 is a catalytic domain (CD). The amino acid sequence containing the CD of Abn7 spans from a starting point of about position 24 of SEQ ID NO:26 to an ending point of about position 444 of SEQ ID NO:26. Based on homology, Abn7 can be assigned to CAZy Family GH 43. As shown in Examples 1 and 2 below, Abn7 exhibits •-arabinofuranosidase activity based on the ability to hydrolyze p-nitrophenyl •-L-arabinofuranoside (PNPA). Example 2 further demonstrates that Abn7 possesses the ability to remove α-L-arabinofuranosyl residues from double substituted xylose residues and also possesses β-xylosidase activity.

Abn7 also possesses significant homology (about 66%) with an arabinofuranosidase from *Humicola insolens* (Genbank Accession No. CAL81199; see also International Publication No. WO 2006/114094) that is active towards the arabinosyl side chain of arabinoxylan (the arabinosyl residue at the 0-3 position of double substituted xylose). Based on this degree of homology, Abn7 is expected to exhibit similar arabinofuranosidase enzymatic activity.

The enzyme CL01470 is encoded by the nucleic acid sequence represented herein as SEQ ID NO:28 and the cDNA sequence represented herein as SEQ ID NO:30. The CL01470 nucleic acid sequence encodes a 303 amino acid sequence, represented herein as SEQ ID NO:29. The signal peptide for CL01470 is located from positions 1 to about position 19 of SEQ ID NO:29, with the mature protein spanning from about position 20 to position 303 of SEQ ID NO:29. Within CL01470 are two domains: a catalytic domain (CD) and a cellulose-binding module (CBM). The amino acid sequence containing the CD of CL01470 spans from a starting point of about position 137 of SEQ ID NO:29 to an ending point of about position 216 of SEQ ID NO:29. The amino acid sequence containing the CBM of CL01470 spans from a starting point of about position 268 of SEQ ID NO:29 to an ending point of about position 303 of SEQ ID NO:29. Based on homology, CL01470 can be assigned to CAZy Families GH 61 and CBM 1. CL01470 also possesses significant homology (about 38% from amino acids 1 to 303 of CL01470) with an endoglucanase from *Volvariella volvacea* (Genbank Accession No. AAT64005; see also Ding et al., *FEMS Microbiol. Lett.* 263:207 (2006)).

The enzyme CL03248 is encoded by the nucleic acid sequence represented herein as SEQ ID NO:31 and the cDNA sequence represented herein as SEQ ID NO:33. The CL03248 nucleic acid sequence encodes a 223 amino acid sequence, represented herein as SEQ ID NO:32. The signal peptide for CL03248 is located from positions 1 to about position 20 of SEQ ID NO:32, with the mature protein spanning from about position 21 to position 223 of SEQ ID NO:32. Within CL03248 is a catalytic domain (CD). The amino acid sequence containing the CD of CL03248 spans from a starting point of about position 137 of SEQ ID NO:32 to an ending point of about position 217 of SEQ ID NO:32. Based on homology, CL03248 can be assigned to CAZy Family GH 61. CL03248 also possesses significant homology (about 38% from amino acids 1 to 222 of CL03248) with an endoglucanase from *Volvariella volvacea* (Genbank Accession No. AAT64005; see also Ding et al., *FEMS Microbiol. Lett.* 263:207 (2006)).

The enzyme CL03778 is encoded by the nucleic acid sequence represented herein as SEQ ID NO:34 and the cDNA sequence represented herein as SEQ ID NO:36. The CL03778 nucleic acid sequence encodes a 242 amino acid sequence, represented herein as SEQ ID NO:35. The signal peptide for CL03778 is located from positions 1 to about position 20 of SEQ ID NO:35, with the mature protein spanning from about position 21 to position 242 of SEQ ID NO:35. Within CL03778 is a catalytic domain (CD). The amino acid sequence containing the CD of CL03778 spans from a starting point of about position 21 of SEQ ID NO:35 to an ending point of about position 231 of SEQ ID NO:35. Based on homology, CL03778 can be assigned to CAZy Family GH 61. CL03778 also possesses significant homology (about 49% from amino acids 40 to 238 of CL03778) with an endoglucanase from *Aspergillus kawachii* (Genbank Accession No. BAB62318).

The enzyme CL04725 is encoded by the nucleic acid sequence represented herein as SEQ ID NO:37 and the cDNA sequence represented herein as SEQ ID NO:39. The CL04725 nucleic acid sequence encodes a 255 amino acid sequence, represented herein as SEQ ID NO:38. The signal peptide for CL04725 is located from positions 1 to about position 19 of SEQ ID NO:38, with the mature protein spanning from about position 20 to position 255 of SEQ ID NO:38. Within CL04725 is a catalytic domain (CD). The amino acid sequence containing the CD of CL04725 spans from a starting point of about position 20 of SEQ ID NO:38 to an ending point of about position 236 of SEQ ID NO:38. Based on homology, CL04725 can be assigned to CAZy Family GH 61. CL04725 also possesses significant homology (about 36% from amino acids 7 to 242 of CL04725) with a cellulose binding protein from *Agaricus bisporus* (Genbank Accession No. AAA53434; see also Armesilla et al., *FEMS Microbiol. Lett.* 116:293 (1994)) and significant homology (about 34% from amino acids 5 to 242 of CL04725) with an endoglucanase from *Aspergillus terreus* NIH 2642 (Genbank Accession No. EAU39094).

The enzyme CL04750 is encoded by the nucleic acid sequence represented herein as SEQ ID NO:40 and the cDNA sequence represented herein as SEQ ID NO:42. The CL04750 nucleic acid sequence encodes a 237 amino acid sequence, represented herein as SEQ ID NO:41. The signal peptide for CL04750 is located from positions 1 to about position 15 of SEQ ID NO:41, with the mature protein spanning from about position 16 to position 237 of SEQ ID NO:41. Within CL04750 is a catalytic domain (CD). The amino acid sequence containing the CD of CL04750 spans from a starting point of about position 16 of SEQ ID NO:41 to an ending point of about position 229 of SEQ ID NO:41. Based on homology, CL04750 can be assigned to CAZy Family GH 61. CL04750 also possesses significant homology (about 54% from amino acids 2 to 237 of CL04750) with an endoglucanase from *Volvariella volvacea* (Genbank Accession No. AAT64005; see also Ding et al., *FEMS Microbiol. Lett.* 263:207 (2006)). As evidenced below in example 12, the protein CL04750 is able to bind to chitin.

The enzyme CL04874 is encoded by the nucleic acid sequence represented herein as SEQ ID NO:43 and the cDNA sequence represented herein as SEQ ID NO:45. The CL04874 nucleic acid sequence encodes a 342 amino acid sequence, represented herein as SEQ ID NO:44. The signal peptide for CL04874 is located from positions 1 to about position 19 of SEQ ID NO:44, with the mature protein spanning from about position 20 to position 342 of SEQ ID NO:44. Within CL04874 is a catalytic domain (CD). The amino acid sequence containing the CD of CL04874 spans from a starting point of about position 20 of SEQ ID NO:44 to an ending point of about position 237 of SEQ ID NO:44. The amino acid sequence containing the CBM of CL04874 spans from a starting point of about position 307 of SEQ ID NO:44 to an ending point of about position 342 of SEQ ID NO:44. Based on homology, CL04874 can be assigned to CAZy Families GH 61 and CBM 1. CL04874 also possesses significant homology (about 55% from amino acids 4 to 342 of CL04874) with an endoglucanase from *Hypocrea jecorina* (Genbank Accession No. CAA71999; see also Saloheimo et al., *Eur. J. Biochem.* 249:584 (1997)).

The enzyme CL05022 is encoded by the nucleic acid sequence represented herein as SEQ ID NO:46 and the cDNA sequence represented herein as SEQ ID NO:48. The CL05022 nucleic acid sequence encodes a 306 amino acid sequence, represented herein as SEQ ID NO:47. The signal peptide for CL05022 is located from positions 1 to about position 15 of SEQ ID NO:47, with the mature protein spanning from about position 16 to position 306 of SEQ ID NO:47. Within CL05022 are two domains: a catalytic domain (CD) and a cellulose-binding module (CBM). The amino acid sequence containing the CD of CL05022 spans from a starting point of about position 135 of SEQ ID NO:47 to an ending point of about position 209 of SEQ ID NO:47. The amino acid sequence containing the CBM of CL05022 spans from a starting point of about position 245 of SEQ ID NO:47 to an ending point of about position 279 of SEQ ID NO:47. Based on homology, CL05022 can be assigned to CAZy Families GH 61 and CBM 1. CL05022 also possesses significant homology (about 48% from amino acids 5 to 305 of CL05022) with an endoglucanase from *Volvariella volvacea* (Genbank Accession No. AAT64005; see also Ding et al., *FEMS Microbiol. Lett.* 263:207 (2006)). As evidenced below in Example 12, the protein CL05022 is able to bind to chitin.

The enzyme CL05366 is encoded by the nucleic acid sequence represented herein as SEQ ID NO:49 and the cDNA sequence represented herein as SEQ ID NO:51. The CL05366 nucleic acid sequence encodes a 246 amino acid sequence, represented herein as SEQ ID NO:50. The signal peptide for CL05366 is located from positions 1 to about position 19 of SEQ ID NO:50, with the mature protein spanning from about position 20 to position 246 of SEQ ID NO:50. Within CL05366 is a catalytic domain (CD). The amino acid sequence containing the CD of CL05366 spans from a starting point of about position 20 of SEQ ID NO:50 to an ending point of about position 228 of SEQ ID NO:50. Based on homology, CL05366 can be assigned to CAZy Family GH 61. CL05366 also possesses significant homology (about 48% from amino acids 3 to 246 of CL05366) with an endoglucanase from *Volvariella volvacea* (Genbank Accession No. AAT64005; see also Ding et al., *FEMS Microbiol. Lett.* 263:207 (2006)). As evidenced below in Example 4, the protein CL05366 contains a carbohydrate binding module.

The enzyme CL06230 is encoded by the nucleic acid sequence represented herein as SEQ ID NO:52 and the cDNA sequence represented herein as SEQ ID NO:54. The CL06230 nucleic acid sequence encodes a 323 amino acid sequence, represented herein as SEQ ID NO:53. The signal peptide for CL06230 is located from positions 1 to about position 18 of SEQ ID NO:53, with the mature protein spanning from about position 19 to position 323 of SEQ ID NO:53. Within CL06230 is a catalytic domain (CD). The amino acid sequence containing the CD of CL06230 spans from a starting point of about position 19 of SEQ ID NO:53 to an ending point of about position 233 of SEQ ID NO:53. The amino acid sequence containing the CBM of CL06230 spans from a starting point of about position 286 of SEQ ID NO:53 to an ending point of about position 323 of SEQ ID NO:53. Based on homology, CL06230 can be assigned to CAZy Families GH 61 and CBM 1. CL06230 also possesses significant homology (about 40% from amino acids 1 to 321 of CL06230) with an endoglucanase from *Volvariella volvacea* (Genbank Accession No. AAT64005; see also Ding et al., *FEMS Microbiol. Lett.* 263:207 (2006)). As evidenced below in Example 12, the protein CL06230 is able to bind to chitin.

The enzyme CL08101 is encoded by the nucleic acid sequence represented herein as SEQ ID NO:55 and the cDNA sequence represented herein as SEQ ID NO:57. The CL08101 nucleic acid sequence encodes a 346 amino acid sequence, represented herein as SEQ ID NO:56. The signal peptide for CL08101 is located from positions 1 to about position 20 of SEQ ID NO:56, with the mature protein spanning from about position 21 to position 346 of SEQ ID NO:NO:56. Within CL08101 is a catalytic domain (CD). The amino acid sequence containing the CD of CL08101 spans from a starting point of about position 20 of SEQ ID NO:NO:56 to an ending point of about position 304 of SEQ ID NO: NO:56. Based on homology, CL08101 can be assigned to CAZy Families GH 61 and CBM 1. CL08101 also possesses significant homology (about 64% from amino acids 6 to 267 of CL08101) with an endoglucanase from *Aspergillus terreus* NIH 2642 (Genbank Accession No. EAU38213).

The enzyme CL09768 is encoded by the nucleic acid sequence represented herein as SEQ ID NO:58 and the cDNA sequence represented herein as SEQ ID NO:60. The CL09768 nucleic acid sequence encodes a 225 amino acid sequence, represented herein as SEQ ID NO:59. The signal peptide for CL09768 is located from positions 1 to about position 17 of SEQ ID NO:59, with the mature protein spanning from about position 18 to position 225 of SEQ ID NO:59. Within CL09768 is a catalytic domain (CD). The amino acid sequence containing the CD of CL09768 spans from a starting point of about position 140 of SEQ ID NO:59 to an ending point of about position 207 of SEQ ID NO:59. Based on homology, CL09768 can be assigned to CAZy Family GH 61. CL09768 also possesses significant homology (about 42% from amino acids 60 to 225 of CL09768) with an endoglucanase from *Volvariella volvacea* (Genbank Accession No. AAT64005; see also Ding et al., *FEMS Microbiol. Lett.* 263:207 (2006)). As evidenced below in Example 12, the protein CL09768 is able to bind to chitin.

The enzyme CL10391 is encoded by the nucleic acid sequence represented herein as SEQ ID NO:61 and the cDNA sequence represented herein as SEQ ID NO:63. The CL10391 nucleic acid sequence encodes a 227 amino acid sequence, represented herein as SEQ ID NO:62. The signal peptide for CL10391 is located from positions 1 to about position 17 of SEQ ID NO:62, with the mature protein spanning from about position 18 to position 227 of SEQ ID NO:62. Within CL10391 is a catalytic domain (CD). The amino acid sequence containing the CD of CL10391 spans from a starting point of about position 139 of SEQ ID NO:62 to an ending point of about position 210 of SEQ ID NO:62. Based on homology, CL10391 can be assigned to CAZy Family GH 61. CL10391 also possesses significant homology (about 39% from amino acids 42 to 227 of CL10391) with an endoglucanase from *Volvariella volvacea* (Genbank Accession No. AAT64005; see also Ding et al., *FEMS Microbiol. Lett.* 263:207 (2006)).

The enzyme CL10518 is encoded by the nucleic acid sequence represented herein as SEQ ID NO:64 and the cDNA sequence represented herein as SEQ ID NO:66. The CL10518 nucleic acid sequence encodes a 235 amino acid sequence, represented herein as SEQ ID NO:65. The signal peptide for CL10518 is located from positions 1 to about position 15 of SEQ ID NO:65, with the mature protein spanning from about position 16 to position 235 of SEQ ID NO:65. Within CL10518 is a catalytic domain (CD). The amino acid sequence containing the CD of CL10518 spans from a starting point of about position 16 of SEQ ID NO:65 to an ending point of about position 227 of SEQ ID NO:65. Based on homology, CL10518 can be assigned to CAZy Family GH 61. CL10518 also possesses significant homology (about 54% from amino acids 2 to 235 of CL10518) with an endoglucanase from *Volvariella volvacea* (Genbank Accession No. AAT64005; see also Ding et al., *FEMS Microbiol. Lett.* 263:207 (2006)).

The enzyme CL10824 is encoded by the nucleic acid sequence represented herein as SEQ ID NO:67 and the cDNA sequence represented herein as SEQ ID NO:69. The CL10824 nucleic acid sequence encodes a 232 amino acid sequence, represented herein as SEQ ID NO:68. The signal peptide for CL10824 is located from positions 1 to about position 17 of SEQ ID NO:68, with the mature protein spanning from about position 18 to position 232 of SEQ ID NO:68. Within CL10824 is a catalytic domain (CD). The amino acid sequence containing the CD of CL10824 spans from a starting point of about position 18 of SEQ ID NO:68 to an ending point of about position 224 of SEQ ID NO:68. Based on homology, CL10824 can be assigned to CAZy Family GH 61. CL10824 also possesses significant homology (about 37% from amino acids 9 to 232 of CL10824) with an endoglucanase from *Volvariella volvacea* (Genbank Accession No. AAT64005; see also Ding et al., *FEMS Microbiol. Lett.* 263:207 (2006)).

The enzyme Axe4 is encoded by the nucleic acid sequence represented herein as SEQ ID NO:70 and the cDNA sequence represented herein as SEQ ID NO:72. The Axe4 nucleic acid sequence encodes a 299 amino acid sequence, represented herein as SEQ ID NO:71. The signal peptide for Axe4 is located from positions 1 to about position 23 of SEQ ID NO:71, with the mature protein spanning from about position 24 to position 299 of SEQ ID NO:71. Within Axe4 is a catalytic domain (CD). The amino acid sequence containing the CD of Axe4 spans from a starting point of about position 42 of SEQ ID NO:71 to an ending point of about position 140 of SEQ ID NO:71. Based on homology, Axe4 can be assigned to CAZy Family CE 1. Axe4 also possesses significant homology (about 31% from amino acids 19 to 299 of Axe4 with an acetyl xylan esterase from *Penicllium purpurogenum* (Genbank Accession No. AAM93261; see also Gordillo et al., *Mycol. Res.* 110:1129 (2006)). Based on this degree of homology, Axe4 is expected to exhibit similar acetyl xylan esterase enzymatic activity.

The enzyme Pec11 is encoded by the nucleic acid sequence represented herein as SEQ ID NO:73 and the cDNA sequence represented herein as SEQ ID NO:75. The Pec11 nucleic acid sequence encodes a 330 amino acid sequence, represented herein as SEQ ID NO:74. The signal peptide for Pec11 is located from positions 1 to about position 15 of SEQ ID NO:74, with the mature protein spanning from about position 16 to position 330 of SEQ ID NO:74. Within Pec11 is a catalytic domain (CD). The amino acid sequence containing the CD of Pec11 spans from a starting point of about position 30 of SEQ ID NO:74 to an ending point of about position 326 of SEQ ID NO:74. Based on homology, Pec11 can be assigned to CAZy Family PL 1. Pec11 also possesses significant homology (about 65% from amino acids 5 to 330 of Pec11) with a pectate lyase from *Colletotrichum gloeosporioides* f. sp. *malvae* (Genbank Accession No. AAD43564; see also Shih et al., *Gene* 243:139 (2000)). Based on this degree of homology, Pec11 is expected to exhibit similar pectate lyase enzymatic activity.

The enzyme Pec12 is encoded by the nucleic acid sequence represented herein as SEQ ID NO:76 and the cDNA sequence represented herein as SEQ ID NO:78. The Pec12 nucleic acid sequence encodes a 326 amino acid sequence, represented herein as SEQ ID NO:77. The signal peptide for Pec12 is located from positions 1 to about position 18 of SEQ ID NO:77, with the mature protein spanning from about position 19 to position 326 of SEQ ID NO:77. Within Pec12 is a catalytic domain (CD). The amino acid sequence containing the CD of Pec12 spans from a starting point of about position 31 of SEQ ID NO:77 to an ending point of about position 322 of SEQ ID NO:77. Based on homology, Pec12 can be assigned to CAZy Family PL 1. Pec12 also possesses significant homology (about 55% from amino acids 12 to 326 of Pec12) with a pectate lyase from *Aspergillus niger* (Genbank Accession No. CAC33162; see also Benen et al., *Biochemistry* 39:15563 (2000)). Based on this degree of homology, Pec12 is expected to exhibit similar pectate lyase enzymatic activity.

The enzyme Pec13 is encoded by the nucleic acid sequence represented herein as SEQ ID NO:79 and the cDNA sequence represented herein as SEQ ID NO:81. The Pec13 nucleic acid sequence encodes a 336 amino acid sequence, represented herein as SEQ ID NO:80. The signal peptide for Pec13 is located from positions 1 to about position 18 of SEQ ID NO:80, with the mature protein spanning from about position 19 to position 336 of SEQ ID NO:80. Within Pec13 is a catalytic domain (CD). The amino acid sequence containing the CD of Pec13 spans from a starting point of about position 21 of SEQ ID NO:80 to an ending point of about position 336 of SEQ ID NO:80. Based on homology, Pec13 can be assigned to CAZy Family PL 1. Pec13 also possesses significant homology (about 43% from amino acids 51 to 253 of Pec13) with a pectate lyase from *Aspergillus* sp. (Genbank Accession No. S51509; see also Ho et al., *Curr. Genet.* 27:142 (1995)). Based on this degree of homology, Pec13 is expected to exhibit similar pectate lyase enzymatic activity.

The enzyme Pec14 is encoded by the nucleic acid sequence represented herein as SEQ ID NO:82 and the cDNA sequence represented herein as SEQ ID NO:84. The Pec14 nucleic acid sequence encodes a 311 amino acid sequence, represented herein as SEQ ID NO:83. The signal peptide for Pec14 is located from positions 1 to about position 20 of SEQ ID NO:83, with the mature protein spanning from about position 21 to position 311 of SEQ ID NO:83. Within Pec14 is a catalytic domain (CD). The amino acid sequence containing the CD of Pec14 spans from a starting point of about position 21 of SEQ ID NO:83 to an ending point of about position 304 of SEQ ID NO:83. Based on homology, Pec14 can be assigned to CAZy Family PL 1. Pec14 also possesses significant homology (about 39% from amino acids 47 to 304 of Pec14) with a pectate lyase from *Bacillus halodurans* C-125 (Genbank Accession No. NP_241564; see also Takami et al., *Nucleic Acid Res.* 28:4317 (2000)). Based on this degree of homology, Pec14 is expected to exhibit similar pectate lyase enzymatic activity.

The enzyme Pec15 is encoded by the nucleic acid sequence represented herein as SEQ ID NO:85 and the cDNA sequence represented herein as SEQ ID NO:87. The Pec15 nucleic acid sequence encodes a 250 amino acid sequence, represented herein as SEQ ID NO:86. The signal peptide for Pec15 is located from positions 1 to about position 23 of SEQ ID NO:86, with the mature protein spanning from about position 24 to position 250 of SEQ ID NO:86. Within Pec15 is a catalytic domain (CD). The amino acid sequence containing the CD of Pec15 spans from a starting point of about position 24 of SEQ ID NO:86 to an ending point of about position 231 of SEQ ID NO:86. Based on homology, Pec15 can be assigned to CAZy Family PL 3. Pec15 also possesses significant homology (about 71% from amino acids 20 to 250 of Pec15) with a pectate lyase from *Fusarium oxysporum* f. sp. *lycopersici* (Genbank Accession No. AAC64368; see also Huertas-Gonzalez et al., *Curr. Genet.* 35:36 (1999)). Based on this degree of homology, Pec15 is expected to exhibit similar pectate lyase enzymatic activity.

The enzyme Rgl1 is encoded by the nucleic acid sequence represented herein as SEQ ID NO:88 and the cDNA sequence represented herein as SEQ ID NO:90. The Rgl1 nucleic acid sequence encodes a 551 amino acid sequence, represented herein as SEQ ID NO:89. The signal peptide for Rgl1 is located from positions 1 to about position 23 of SEQ ID NO:89, with the mature protein spanning from about position 24 to position 551 of SEQ ID NO:89. Within Rgl1 is a catalytic domain (CD). The amino acid sequence containing the CD of Rgl1 spans from a starting point of about position 229 of SEQ ID NO:89 to an ending point of about position 337 of SEQ ID NO:89. Based on homology, Rgl1 can be assigned to CAZy Family PL 4. Rgl1 also possesses significant homology (about 78% from amino acids 1 to 533 of Rgl1) with a rhamnogalacturonan lyase from *Neurospora crassa* OR74A (Genbank Accession No. XP_960560). Based on this degree of homology, Rgl1 is expected to exhibit similar rhamnogalacturonan lyase enzymatic activity.

The enzyme CL10366 is encoded by the nucleic acid sequence represented herein as SEQ ID NO:94 and the cDNA sequence represented herein as SEQ ID NO:96. The CL10366 nucleic acid sequence encodes a 254 amino acid sequence, represented herein as SEQ ID NO:95. The signal peptide for CL10366 is located from positions 1 to about position 23 of SEQ ID NO:95, with the mature protein spanning from about position 24 to position 254 of SEQ ID NO:95. Within CL10366 is a catalytic domain (CD). The amino acid sequence containing the CD of CL10366 spans from a starting point of about position 24 of SEQ ID NO:95 to an ending point of about position 246 of SEQ ID NO:95. Based on homology, CL10366 can be assigned to CAZy Family GH 61. CL10366 also possesses significant homology (about 39% from amino acids 8 to 252 of CL10366) with a cellulose binding protein from *Agaricus bisporus* (Genbank Accession No. AAA53434; see also Armesilla et al., *FEMS Microbiol. Lett.* 116:293 (1994)) and significant homology (about 30% from amino acids 1 to 252 of CL10366) with an endoglucanase from *Aspergillus terreus* NIH 2642 (Genbank Accession No. EAU39094). Based on this degree of homology, CL10366 is expected to exhibit similar cellulose binding activity and endoglucanase enzymatic activity.

The enzyme CL02839 is encoded by the nucleic acid sequence represented herein as SEQ ID NO:97 and the cDNA sequence represented herein as SEQ ID NO:99. The CL02839 nucleic acid sequence encodes a 222 amino acid sequence, represented herein as SEQ ID NO:98. The signal peptide for CL02839 is located from positions 1 to about position 18 of SEQ ID NO:98, with the mature protein spanning from about position 19 to position 222 of SEQ ID NO:98. Within CL02839 is a catalytic domain (CD). The amino acid sequence containing the CD of CL02839 spans from a starting point of about position 19 of SEQ ID NO:98 to an ending point of about position 214 of SEQ ID NO:98. Based on homology, CL02839 can be assigned to CAZy Family GH 61. CL02839 also possesses significant homology (about 38% from amino acids 4 to 222 of CL02839) with an endoglucanase from *Volvariella volvacea* (Genbank Accession No. AAT64005; see also Ding et al., *FEMS Microbiol. Lett.* 263:207 (2006)).

The enzyme CL03723 is encoded by the nucleic acid sequence represented herein as SEQ ID NO:100 and the cDNA sequence represented herein as SEQ ID NO:102. The CL03723 nucleic acid sequence encodes a 445 amino acid sequence, represented herein as SEQ ID NO:101. The signal peptide for CL03723 is located from positions 1 to about position 21 of SEQ ID NO:101, with the mature protein spanning from about position 22 to position 445 of SEQ ID NO:101. Within CL03723 is a catalytic domain (CD). The amino acid sequence containing the CD of CL03723 spans from a starting point of about position 129 of SEQ ID NO:101 to an ending point of about position 241 of SEQ ID NO:101. Based on homology, CL03723 can be assigned to CAZy Family GH 61. CL03723 also possesses significant homology (about 32% from amino acids 7 to 261 of CL03723) with an endoglucanase from *Volvariella volvacea* (Genbank Accession No. AAT64005; see also Ding et al., *FEMS Microbiol. Lett.* 263:207 (2006)).

The enzyme CL04859 is encoded by the nucleic acid sequence represented herein as SEQ ID NO:103 and the cDNA sequence represented herein as SEQ ID NO:105. The CL04859 nucleic acid sequence encodes a 245 amino acid sequence, represented herein as SEQ ID NO:104. The signal peptide for CL04859 is located from positions 1 to about position 19 of SEQ ID NO:104, with the mature protein spanning from about position 20 to position 245 of SEQ ID NO:104. Within CL04859 is a catalytic domain (CD). The amino acid sequence containing the CD of CL04859 spans from a starting point of about position 133 of SEQ ID NO:104 to an ending point of about position 227 of SEQ ID NO:104. Based on homology, CL04859 can be assigned to CAZy Family GH 61. CL04859 also possesses significant homology (about 36% from amino acids 20 to 236 of CL04859) with an endoglucanase from *Aspergillus kawachii* (Genbank Accession No. BAB62318).

The enzyme CL09767 is encoded by the nucleic acid sequence represented herein as SEQ ID NO:106 and the cDNA sequence represented herein as SEQ ID NO:108. The CL09767 nucleic acid sequence encodes a 224 amino acid sequence, represented herein as SEQ ID NO:107. The signal peptide for CL09767 is located from position 1 to about position 16 of SEQ ID NO:107, with the mature protein spanning from about position 17 to position 224 of SEQ ID NO:107. Within CL09767 is a catalytic domain (CD). The amino acid sequence containing the CD of CL09767 spans from a starting point of about position 18 of SEQ ID NO:107 to an ending point of about position 216 of SEQ ID NO:107. Based on homology, CL09767 can be assigned to CAZy Family GH 61. CL09767 also possesses significant homology (about 37% from amino acids 4 to 222 of CL09767) with an endoglucanase from *Volvariella volvacea* (Genbank Accession No. AAT64005; see also Ding et al., *FEMS Microbiol. Lett.* 263:207 (2006)).

The enzyme Bxl4 is encoded by the nucleic acid sequence represented herein as SEQ ID NO:109 and the cDNA sequence represented herein as SEQ ID NO:111. The Bxl4 nucleic acid sequence encodes a 537 amino acid sequence, represented herein as SEQ ID NO:110. Within Bxl4 is a catalytic domain (CD). The amino acid sequence containing the CD of Bxl4 spans from a starting point of about position 4 of SEQ ID NO: 110 to an ending point of about position 311 of SEQ ID NO: 110. Based on homology, Bxl4 can be assigned to CAZy Family GH 43. Bxl4 also possesses significant homology (about 60% from amino acids 4 to 525 of Bxl4) with an β-xylosidase from *Rhizobium etli* CFN 42 (Genbank Accession No. ABC91230). Based on this degree of homology, Bxl4 is expected to exhibit similar a β-xylosidase enzymatic activity.

The enzyme Abn9 is encoded by the nucleic acid sequence represented herein as SEQ ID NO:112 and the cDNA sequence represented herein as SEQ ID NO:114. The Abn9 nucleic acid sequence encodes a 327 amino acid sequence, represented herein as SEQ ID NO:113. Within Abn9 is a catalytic domain (CD). The amino acid sequence containing the CD of Abn9 spans from a starting point of about position 4 of SEQ ID NO:113 to an ending point of about position 323 of SEQ ID NO:113. Based on homology, Abn9 can be assigned to CAZy Family GH 43. Abn9 also possesses significant homology (about 71% from amino acids 3 to 321 of Abn9) with an β-xylosidase from *Aspergillus terreus* NIH 2642 (Genbank Accession No. EAU38739) and significant homology (about 60% from amino acids 3 to 326 of Abn9) with an α-N-arabinofuranosidase from *Flavobacterium johnsoniae* UW101 (Genbank Accession No. ABQ05030). Based on these degrees of homology, Abn9 is expected to exhibit similar β-xylosidase and α-N-arabinofuranosidase enzymatic activities.

The enzyme CL02469 is encoded by the nucleic acid sequence represented herein as SEQ ID NO:115 and the cDNA sequence represented herein as SEQ ID NO:117. The CL02469 nucleic acid sequence encodes a 1106 amino acid sequence, represented herein as SEQ ID NO:118. The signal peptide for CL02469 is located from positions 1 to about position 16 of SEQ ID NO:118, with the mature protein spanning from about position 17 to position 1106 of SEQ ID NO:118. Within CL02469 are two domains: a catalytic domain (CD) and a cellulose-binding module (CBM). The amino acid sequence containing the CD of CL02469 spans from a starting point of about position 110 of SEQ ID NO:118 to an ending point of about position 662 of SEQ ID NO:118. The amino acid sequence containing the CBM of CL02469 spans from a starting point of about position 663 of SEQ ID NO:118 to an ending point of about position 703 of SEQ ID NO:118. Based on homology, CL02469 can be assigned to CAZy Family GH 3. CL02469 also possesses significant homology (about 37% from amino acids 40 to 764 of CL02469) with an β-xylosidase from *Sulfolobus solfataricus* P2 (Genbank Accession No. AAK43134) and significant homology (about 65% from amino acids 28 to 764 of CL02469) with an β-glucosidase *Aspergillus clavatus* NRRL 1 (Genbank Accession No. EAW12608). Based on these degrees of homology, CL02469 is expected to exhibit similar β-xylosidase and β-glucosidase enzymatic activities.

The enzyme CL05182 is encoded by the nucleic acid sequence represented herein as SEQ ID NO:118 and the cDNA sequence represented herein as SEQ ID NO:120. The CL05182 nucleic acid sequence encodes a 919 amino acid sequence, represented herein as SEQ ID NO:119. The signal peptide for CL05182 is located from positions 1 to about position 23 of SEQ ID NO:119, with the mature protein spanning from about position 24 to position 919 of SEQ ID NO:119. Within CL05182 is a catalytic domain (CD). The amino acid sequence containing the CD of CL05182 spans from a starting point of about position 45 of SEQ ID NO:119 to an ending point of about position 663 of SEQ ID NO:119. Based on homology, CL05182 can be assigned to CAZy Family GH 3. CL05182 also possesses significant homology (about 58% from amino acids 29 to 904 of CL05182) with a β-glucosidase from *Thermoascus auramtiacus* (Genbank Accession No. AAY33983; see also Hong et al., *Appl. Microbiol. Biotechnol.* 73:80 (2006)). Based on this degree of homology, CL05182 is expected to exhibit similar β-glucosidase enzymatic activity.

The enzyme Bgl2 is encoded by the nucleic acid sequence represented herein as SEQ ID NO:121 and the cDNA sequence represented herein as SEQ ID NO:123. The Bgl2 nucleic acid sequence encodes a 968 amino acid sequence, represented herein as SEQ ID NO:122. Within Bgl2 is a catalytic domain (CD). The amino acid sequence containing the CD of Bgl2 spans from a starting point of about position 166 of SEQ ID NO:122 to an ending point of about position 773 of SEQ ID NO:122. Based on homology, CL11589 can be assigned to CAZy Family GH 3. Bgl2 also possesses significant homology (about 55% from amino acids 241 to 968 of Bgl2) with a β-glucosidase from *Coccidioides immitis* (Genbank Accession No. AAL09827). Based on this degree of homology, Bgl2 is expected to exhibit similar β-glucosidase enzymatic activity.

The enzyme CL08144 is encoded by the nucleic acid sequence represented herein as SEQ ID NO:124 and the cDNA sequence represented herein as SEQ ID NO:126. The CL08144 nucleic acid sequence encodes a 922 amino acid sequence, represented herein as SEQ ID NO:125. Within CL08144 is a catalytic domain (CD). The amino acid sequence containing the CD of CL08144 spans from a starting point of about position 69 of SEQ ID NO:125 to an ending point of about position 298 of SEQ ID NO:125. Based on homology, CL11589 can be assigned to CAZy Family GH 3. CL08144 also possesses significant homology (about 70% from amino acids 4 to 798 of CL08144) with a β-N-acetyl-glucosaminidase from *Neurospora crassa* (Genbank Accession No. CAE85548). Based on this degree of homology, CL08144 is expected to exhibit similar β-N-acetylglucosaminidase enzymatic activity.

The enzyme CL09335 is encoded by the nucleic acid sequence represented herein as SEQ ID NO:127 and the cDNA sequence represented herein as SEQ ID NO:129. The CL09335 nucleic acid sequence encodes a 356 amino acid sequence, represented herein as SEQ ID NO:128. The signal peptide for CL09335 is located from positions 1 to about position 19 of SEQ ID NO:128, with the mature protein spanning from about position 20 to position 356 of SEQ ID NO:128. Within CL09335 is a catalytic domain (CD). The amino acid sequence containing the CD of CL09335 spans from a starting point of about position 27 of SEQ ID NO:128 to an ending point of about position 355 of SEQ ID NO:128. Based on homology, CL09335 can be assigned to CAZy Family GH 3. CL09335 also possesses significant homology (about 79% from amino acids 23 to 347 of CL09335) with a β-hexosaminidase from *Aspergillus nidulans* FGSC A4 (Genbank Accession No. EAA63328). Based on this degree of homology, CL09335 is expected to exhibit similar β-hexosaminidase enzymatic activity.

The enzyme CL04514 is encoded by the nucleic acid sequence represented herein as SEQ ID NO:130 and the cDNA sequence represented herein as SEQ ID NO:132. The CL04514 nucleic acid sequence encodes a 513 amino acid sequence, represented herein as SEQ ID NO:131. The signal peptide for CL04514 is located from positions 1 to about position 18 of SEQ ID NO:131, with the mature protein spanning from about position 19 to position 513 of SEQ ID NO:131. Within CL04514 is a catalytic domain (CD). The amino acid sequence containing the CD of CL04514 spans from a starting point of about position 228 of SEQ ID NO:131 to an ending point of about position 372 of SEQ ID NO:131. Based on homology, CL04514 can be assigned to CAZy Family GH 3. CL04514 also possesses significant homology (about 29% from amino acids 33 to 377 of CL04514) with a β-N-acetylglucosaminidase from *Aspergillus clavatus* NRRL 1 (Genbank Accession No. EAW15083). Based on this degree of homology, CL04514 is expected to exhibit similar β-N-acetylglucosaminidase enzymatic activity.

The enzyme CL06190 is encoded by the nucleic acid sequence represented herein as SEQ ID NO:133 and the cDNA sequence represented herein as SEQ ID NO:135. The CL06190 nucleic acid sequence encodes a 464 amino acid sequence, represented herein as SEQ ID NO:134. The signal peptide for CL06190 is located from positions 1 to about position 22 of SEQ ID NO:134, with the mature protein spanning from about position 23 to position 464 of SEQ ID NO:134. Within CL06190 are two domains: a catalytic domain (CD) and a cellulose-binding module (CBM). The amino acid sequence containing the CD of CL06190 spans from a starting point of about position 24 of SEQ ID NO:134 to an ending point of about position 398 of SEQ ID NO:134. The amino acid sequence containing the CBM of CL06190 spans from a starting point of about position 429 of SEQ ID NO:134 to an ending point of about position 464 of SEQ ID NO:134. Based on homology, CL06190 can be assigned to CAZy Families GH 7 and CBM 1. CL06190 also possesses significant homology (about 63% from amino acids 5 to 464 of CL06190) with an endoglucanase from *Hypocrea pseudokoningii* (Genbank Accession No. ABM90986). Based on this degree of homology, CL06190 is expected to exhibit similar endoglucanase enzymatic activity.

The enzyme CL00455 is encoded by the nucleic acid sequence represented herein as SEQ ID NO:136 and the cDNA sequence represented herein as SEQ ID NO:138. The CL00455 nucleic acid sequence encodes a 456 amino acid sequence, represented herein as SEQ ID NO:137. The signal peptide for CL00455 is located from positions 1 to about position 20 of SEQ ID NO:137, with the mature protein spanning from about position 21 to position 456 of SEQ ID NO:137. Within CL00455 is a catalytic domain (CD). The amino acid sequence containing the CD of CL00455 spans from a starting point of about position 21 of SEQ ID NO:137 to an ending point of about position 455 of SEQ ID NO:137. Based on homology, CL00455 can be assigned to CAZy Family GH 7. CL00455 also possesses significant homology (about 66% from amino acids 1 to 455 of CL00455) with a cellobiohydrolase from *Irpex lacteus* (Genbank Accession No. BAD16575). Based on this degree of homology, CL00455 is expected to exhibit similar cellobiohydrolase enzymatic activity.

The enzyme CL02823 is encoded by the nucleic acid sequence represented herein as SEQ ID NO:139 and the cDNA sequence represented herein as SEQ ID NO:141. The CL02823 nucleic acid sequence encodes a 280 amino acid sequence, represented herein as SEQ ID NO:140. The signal peptide for CL02823 is located from positions 1 to about position 21 of SEQ ID NO:140, with the mature protein spanning from about position 22 to position 280 of SEQ ID NO:140. Within CL02823 is a catalytic domain (CD). The amino acid sequence containing the CD of CL02823 spans from a starting point of about position 62 of SEQ ID NO:140 to an ending point of about position 280 of SEQ ID NO:140. Based on homology, CL02823 can be assigned to CAZy Family GH 16. CL02823 possesses significant homology (about 64% from amino acids 6 to 278 of CL02823) with a β-glucosidase from *Neosartorya fischeri* NRRL 181 (Genbank Accession No. XP_001258587). Based on this degree of homology, CL02823 is expected to exhibit similar β-glucosidase enzymatic activity. β-glucosidases often have broad substrate specificity, and can hydrolyze β-1,3 bonds between glucose residues in addition to β-1,4 bonds. Therefore, CL02823 is also expected to possess the ability to bind to lichenan and lichenase activity (the ability to hydrolyze lichenan, a linear 1,3-1,4-β-D glucan). As evidenced below in Example 13, the protein CL02823 binds to lichenan.

CL02823 also possesses significant homology (about 59% from amino acids 19 to 271 of CL02823) with an endo-1,3-β-glucanase (laminarinase) from *Neurospora crassa* NRRL 181 (Genbank Accession No. CAF06015). Based on this degree of homology, CL02823 is expected to exhibit similar endo-1,3-β-glucanase (laminarinase) enzymatic activity. The enzyme Xyl11 is encoded by the nucleic acid sequence represented herein as SEQ ID NO:142 and the cDNA sequence represented herein as SEQ ID NO:144. The Xyl11 nucleic acid sequence encodes a 326 amino acid sequence, represented herein as SEQ ID NO:143. The signal peptide for Xyl11 is located from positions 1 to about position 15 of SEQ ID NO:143, with the mature protein spanning from about position 16 to position 326 of SEQ ID NO:143. Within Xyl11 is a catalytic domain (CD). The amino acid sequence containing the CD of Xyl11 spans from a starting point of about position 23 of SEQ ID NO:143 to an ending point of about position 324 of SEQ ID NO:143. Based on homology, CL08529 can be assigned to CAZy Family GH 10. Xyl11 also possesses significant homology (about 71% from amino acids 23 to 324 of Xyl11) with a xylanase from *Cryptovalsa* sp. BCC 7197 (Genbank Accession No. AAU89274; see also Boonyapakron et al., *DNA Seq.* 16:372 (2005)). Based on this degree of homology, Xyl11 is expected to exhibit similar xylanase enzymatic activity. As evidenced below in Example 14, the enzyme Xyl 11 exhibits endo-xylanase activity.

The enzyme Xyl10 is encoded by the nucleic acid sequence represented herein as SEQ ID NO:145 and the cDNA sequence represented herein as SEQ ID NO:147. The Xyl10 nucleic acid sequence encodes a 222 amino acid sequence, represented herein as SEQ ID NO:146. The signal peptide for Xyl10 is located from positions 1 to about position 18 of SEQ ID NO:146, with the mature protein spanning from about position 19 to position 222 of SEQ ID NO:146. Within Xyl10 is a catalytic domain (CD). The amino acid sequence containing the CD of Xyl10 spans from a starting point of about position 35 of SEQ ID NO:146 to an ending point of about position 222 of SEQ ID NO:146. Based on homology, Xyl10 can be assigned to CAZy Family GH 11. Xyl10 also possesses significant homology (about 69% from amino acids 1 to 222 of Xyl10) with a xylanase from *Chaetomium thermophilum* (Genbank Accession No. CAD48751; see also Mantyla et al., *Appl. Microbiol. Biotechnol.* (2007)). Based on this degree of homology, Xyl10 is expected to exhibit similar xylanase enzymatic activity. As evidenced below in Examples 14 and 15, the enzyme Xyl10 possesses exo-xylanase activity.

The enzyme CL09769 is encoded by the nucleic acid sequence represented herein as SEQ ID NO:151 and the cDNA sequence represented herein as SEQ ID NO:153. The CL09769 nucleic acid sequence encodes a 578 amino acid sequence, represented herein as SEQ ID NO:152. The signal peptide for CL09769 is located from positions 1 to about position 24 of SEQ ID NO:152, with the mature protein spanning from about position 25 to position 578 of SEQ ID NO:152. Within CL09769 is a catalytic domain (CD). The amino acid sequence containing the CD of CL09769 spans from a starting point of about position 30 of SEQ ID NO:152 to an ending point of about position 574 of SEQ ID NO:152. CL09769 possesses significant homology (about 66% from amino acids 35 to 570 of CL09769) with a cellobiose dehydrogenase from *Humicola insolens* (Genbank Accession No. AAF69005; see also Xu et al., *Enzyme Microb. Technol.* 28:744 (2001)). Based on this degree of homology, CL09769 is expected to exhibit similar cellobiose dehydrogenase enzymatic activity.

The enzyme Xyl7 is encoded by the nucleic acid sequence represented herein as SEQ ID NO:154 and the cDNA sequence represented herein as SEQ ID NO:156. The Xyl7 nucleic acid sequence encodes a 278 amino acid sequence, represented herein as SEQ ID NO:155. The signal peptide for Xyl7 is located from positions 1 to about position 19 of SEQ ID NO:155, with the mature protein spanning from about position 20 to position 278 of SEQ ID NO:155. Within Xyl7 are two domains: a catalytic domain (CD) and a cellulose-binding module (CBM). The amino acid sequence containing the CD of Xyl7 spans from a starting point of about position 30 of SEQ ID NO:155 to an ending point of about position 225 of SEQ ID NO:155. The amino acid sequence containing the CBM of Xyl7 spans from a starting point of about position 244 of SEQ ID NO:155 to an ending point of about position 278 of SEQ ID NO:155. Based on homology, Xyl7 can be assigned to CAZy Families GH 11 and CBM 1. Xyl7 also possesses significant homology (about 55% from amino acids 1 to 278 of Xyl7) with a xylanase from *Phanerochaete chrysosprium* (Genbank Accession No. AAG44994). Based on this degree of homology, Xyl7 is expected to exhibit similar xylanase enzymatic activity. As evidenced below in Examples 14 and 15, the enzyme Xyl7 exhibits endo-xylanase activity.

The enzyme Xyl8 is encoded by the nucleic acid sequence represented herein as SEQ ID NO:157 and the cDNA sequence represented herein as SEQ ID NO:159. The Xyl8 nucleic acid sequence encodes a 230 amino acid sequence, represented herein as SEQ ID NO:158. The signal peptide for Xyl8 is located from positions 1 to about position 16 of SEQ ID NO:158, with the mature protein spanning from about position 17 to position 230 of SEQ ID NO:158. Within Xyl8 is a catalytic domain (CD). The amino acid sequence containing the CD of Xyl8 spans from a starting point of about position 42 of SEQ ID NO:158 to an ending point of about position 230 of SEQ ID NO:158. Based on homology, Xyl8 can be assigned to CAZy Family GH 11. Xyl8 also possesses significant homology (about 73% from amino acids 1 to 230 of Xyl8) with a xylanase from *Acrophialophora nainiana* (Genbank Accession No. ABG37635). Based on this degree of homology, Xyl8 is expected to exhibit similar xylanase enzymatic activity. As evidenced below in Examples 14 and 16, the enzyme Xyl8 is able to bind to xylan and exhibits endo-xylanase activity.

The enzyme Xyl9 is encoded by the nucleic acid sequence represented herein as SEQ ID NO:148 and the cDNA sequence represented herein as SEQ ID NO:150. The Xyl9 nucleic acid sequence encodes a 223 amino acid sequence, represented herein as SEQ ID NO:149. The signal peptide for Xyl9 is located from positions 1 to about position 18 of SEQ ID NO:149, with the mature protein spanning from about position 19 to position 223 of SEQ ID NO:149. Within Xyl9 is a catalytic domain (CD). The amino acid sequence containing the CD of Xyl9 spans from a starting point of about position 40 of SEQ ID NO:149 to an ending point of about position 221 of SEQ ID NO:149. Based on homology, Xyl9 can be assigned to CAZy Family GH 11. Xyl9 also possesses significant homology (about 82% from amino acids 19 to 221 of Xyl9) with a xylanase from *Chaetomium gracile* (Genbank Accession No. BAA08649). Based on this degree of homology, Xyl9 is expected to exhibit similar xylanase enzymatic activity. As evidenced below in Example 14, the enzyme Xyl9 exhibits endo-xylanase activity.

The enzyme Pgx1 is encoded by the nucleic acid sequence represented herein as SEQ ID NO:160 and the cDNA sequence represented herein as SEQ ID NO:162. The Pgx1 nucleic acid sequence encodes a 469 amino acid sequence, represented herein as SEQ ID NO:161. The signal peptide for Pgx1 is located from positions 1 to about position 19 of SEQ ID NO:161, with the mature protein spanning from about position 20 to position 469 of SEQ ID NO:161. Within Pgx1 is a catalytic domain (CD). The amino acid sequence containing the CD of Pgx1 spans from a starting point of about position 107 of SEQ ID NO:161 to an ending point of about position 455 of SEQ ID NO:161. Based on homology, Pgx1 can be assigned to CAZy Family GH 28. Pgx1 also possesses significant homology (about 69% from amino acids 71 to 435 of Pgx1) with an exo-polygalacturonase from *Aspergillus nidulans* (Genbank Accession No. AA061898). Based on this degree of homology, Pgx1 is expected to exhibit similar exo-polygalacturonase enzymatic activity. As evidenced below in Example 17, the enzyme Pgx1 exhibits polygalacturonase activity.

The enzyme Rgx1 is encoded by the nucleic acid sequence represented herein as SEQ ID NO:163 and the cDNA sequence represented herein as SEQ ID NO:165. The Rgx1 nucleic acid sequence encodes a 423 amino acid sequence, represented herein as SEQ ID NO:164. The signal peptide for Rgx1 is located from positions 1 to about position 19 of SEQ ID NO:164, with the mature protein spanning from about position 20 to position 423 of SEQ ID NO:164. Within Rgx1 is a catalytic domain (CD). The amino acid sequence containing the CD of Rgx1 spans from a starting point of about position 65 of SEQ ID NO:164 to an ending point of about position 403 of SEQ ID NO:164. Based on homology, Rgx1 can be assigned to CAZy Family GH 28. Rgx1 also possesses significant homology (about 34% from amino acids 50 to 414 of Rgx1) with an exo-rhamnogalacturonase from *Aspergillus niger* (Genbank Accession No. ABD61567). Based on this degree of homology, Rgx1 is expected to exhibit similar exo-rhamnogalacturonase enzymatic activity.

The enzyme CL07563 is encoded by the nucleic acid sequence represented herein as SEQ ID NO:166 and the cDNA sequence represented herein as SEQ ID NO:168. The CL07563 nucleic acid sequence encodes a 342 amino acid sequence, represented herein as SEQ ID NO:167. The signal peptide for CL07563 is located from positions 1 to about position 18 of SEQ ID NO:167, with the mature protein spanning from about position 19 to position 342 of SEQ ID NO:167. Within CL07563 is a catalytic domain (CD). The amino acid sequence containing the CD of CL07563 spans from a starting point of about position 75 of SEQ ID NO:167 to an ending point of about position 342 of SEQ ID NO:167. Based on homology, CL07563 can be assigned to CAZy Family GH 5. CL07563 also possesses significant homology (about 58% from amino acids 1 to 342 of CL07563) with an endoglucanase from *Thermoascus aurantiacus* (Genbank Accession No. AAL88714). Based on this degree of homology, CL07563 is expected to exhibit similar endoglucanase enzymatic activity.

The enzyme CL00103 is encoded by the nucleic acid sequence represented herein as SEQ ID NO:169 and the cDNA sequence represented herein as SEQ ID NO:171. The CL00103 nucleic acid sequence encodes a 420 amino acid sequence, represented herein as SEQ ID NO:170. The signal peptide for CL00103 is located from positions 1 to about position 26 of SEQ ID NO:170, with the mature protein spanning from about position 27 to position 420 of SEQ ID NO:170. Within CL00103 is a catalytic domain (CD). The amino acid sequence containing the CD of CL00103 spans from a starting point of about position 59 of SEQ ID NO:170 to an ending point of about position 420 of SEQ ID NO:170. Based on homology, CL00103 can be assigned to CAZy Family GH 5. CL00103 also possesses significant homology (about 37% from amino acids 62 to 398 of CL00103) with a cellulase from *Stigmatella aurantiaca* (Genbank Accession No. CAD19084). Based on this degree of homology, CL00103 is expected to exhibit similar cellulase enzymatic activity.

The enzyme CL02959 is encoded by the nucleic acid sequence represented herein as SEQ ID NO:172 and the cDNA sequence represented herein as SEQ ID NO:174. The CL02959 nucleic acid sequence encodes a 370 amino acid sequence, represented herein as SEQ ID NO:173. The signal peptide for CL02959 is located from positions 1 to about position 17 of SEQ ID NO:173, with the mature protein spanning from about position 18 to position 370 of SEQ ID NO:173. Within CL02959 is a catalytic domain (CD). The amino acid sequence containing the CD of CL02959 spans from a starting point of about position 31 of SEQ ID NO:173 to an ending point of about position 337 of SEQ ID NO:173. Based on homology, CL02959 can be assigned to CAZy Family GH 5. CL02959 also possesses significant homology (about 62% from amino acids 19 to 366 of CL02959) with a β-mannanase from *Hypocrea jecorina* (Genbank Accession No. AAA34208) and significant homology (about 60% from amino acids 19 to 364 of CL02959) with an endo-1,4-β-mannosidase from *Aspergillus fumigatus* Af293 (Genbank Accession No. XP_746824). Based on these degrees of homology, CL02959 is expected to exhibit similar β-mannanase and endo-1,4-β-mannosidase enzymatic activity.

The enzyme Man2 is encoded by the nucleic acid sequence represented herein as SEQ ID NO: 175 and the cDNA sequence represented herein as SEQ ID NO:177. The Man2 nucleic acid sequence encodes a 410 amino acid sequence, represented herein as SEQ ID NO:176. The signal peptide for Man2 is located from positions 1 to about position 21 of SEQ ID NO:176, with the mature protein spanning from about position 22 to position 410 of SEQ ID NO:176. Within Man2 is a catalytic domain (CD). The amino acid sequence containing the CD of Man2 spans from a starting point of about position 25 of SEQ ID NO:176 to an ending point of about position 401 of SEQ ID NO:176. Based on homology, Man2 can be assigned to CAZy Family GH 5. Man2 also possesses significant homology (about 72% from amino acids 25 to 407 of Man2) with an endo-1,4-β-mannanase from *Emericella nidulans* (Genbank Accession No. ABF50878) and significant homology (about 39% from amino acids 6 to 402 of Man2) with an endo-1,4-β-mannosidase from *Aspergillus fumigatus* Af293 (Genbank Accession No. XP_746824). Based on these degrees of homology, Man2 is expected to exhibit similar endo-1,4-β-mannanase and endo-1,4-β-mannosidase enzymatic activity.

The enzyme CL06986 is encoded by the nucleic acid sequence represented herein as SEQ ID NO:178 and the cDNA sequence represented herein as SEQ ID NO:180. The CL06986 nucleic acid sequence encodes a 408 amino acid sequence, represented herein as SEQ ID NO:179. The signal peptide for CL06986 is located from positions 1 to about position 21 of SEQ ID NO:179, with the mature protein spanning from about position 22 to position 408 of SEQ ID NO:179. Within CL06986 is a catalytic domain (CD). The amino acid sequence containing the CD of CL06986 spans from a starting point of about position 123 of SEQ ID NO:179 to an ending point of about position 204 of SEQ ID NO:179. Based on homology, CL06986 can be assigned to CAZy Family GH 5. CL06986 also possesses significant homology (about 72% from amino acids 25 to 405 of CL06986) with an endo-1,4-β-mannosidase from *Emericella nidulans* (Genbank Accession No. ABF50878). Based on this degree of homology, CL06986 is expected to exhibit similar endo-1,4-β-mannosidase enzymatic activity. CL06986 may also possess galactanase enzymatic activity.

The enzyme Man3 is encoded by the nucleic acid sequence represented herein as SEQ ID NO: 181 and the cDNA sequence represented herein as SEQ ID NO:183. The Man3 nucleic acid sequence encodes a 503 amino acid sequence, represented herein as SEQ ID NO:182. The signal peptide for Man3 is located from positions 1 to about position 21 of SEQ ID NO:182, with the mature protein spanning from about position 22 to position 503 of SEQ ID NO:182. Within Man3 are two domains: a catalytic domain (CD) and a cellulose-binding module (CBM). The amino acid sequence containing the CD of Man3 spans from a starting point of about position 184 of SEQ ID NO:182 to an ending point of about position 501 of SEQ ID NO:182. The amino acid sequence containing the CBM of Man3 spans from a starting point of about position 42 of SEQ ID NO:182 to an ending point of about position 182 of SEQ ID NO:182. Based on homology, Man3 can be assigned to CAZy Families GH 26 and CBM 35. Man3 also possesses significant homology (about 47% from amino acids 111 to 497 of Man3) with a β-mannanase from *Dictyoglomus thermophilum* (Genbank Accession No. AAB82454; see also Gibbs et al., *Curr. Microbiol.* 39:351 (1999)) and significant homology with a β-mannanase from *Humicola insolens* (Genbank Accession No. AAQ31840) Based on this degree of homology, Man3 is expected to exhibit similar β-mannanase enzymatic activity.

The enzyme Abf4 is encoded by the nucleic acid sequence represented herein as SEQ ID NO:184 and the cDNA sequence represented herein as SEQ ID NO:186. The Abf4 nucleic acid sequence encodes a 512 amino acid sequence, represented herein as SEQ ID NO:185. Within Abf4 is a catalytic domain (CD). The amino acid sequence containing the CD of Abf4 spans from a starting point of about position 41 of SEQ ID NO:185 to an ending point of about position 502 of SEQ ID NO:185. Based on homology, Abf4 can be assigned to CAZy Family GH 51. Abf4 also possesses significant homology (about 66% from amino acids 1 to 509 of Abf4) with an α-arabinofuranosidase from *Emericella nidulans* (Genbank Accession No. ABF50847). Based on this degree of homology, Abf4 is expected to exhibit similar α-arabinofuranosidase enzymatic activity.

The enzyme CL11246 is encoded by the nucleic acid sequence represented herein as SEQ ID NO:187 and the cDNA sequence represented herein as SEQ ID NO:189. The CL11246 nucleic acid sequence encodes a 316 amino acid sequence, represented herein as SEQ ID NO:188. The signal peptide for CL11246 is located from positions 1 to about position 28 of SEQ ID NO:188, with the mature protein spanning from about position 29 to position 316 of SEQ ID NO:188. Within CL11246 is a catalytic domain (CD). The amino acid sequence containing the CD of CL11246 spans from a starting point of about position 24 of SEQ ID NO:188 to an ending point of about position 282 of SEQ ID NO:188. Based on homology, CL11246 can be assigned to CAZy Family GH 75. CL11246 also possesses significant homology (about 48% from amino acids 17 to 271 of CL11246) with a chitosanase from *Fusarium solani* f. *robiniae* (Genbank Accession No. BAC10609). Based on this degree of homology, CL11246 is expected to exhibit similar chitosanase enzymatic activity.

The enzyme CL02619 is encoded by the nucleic acid sequence represented herein as SEQ ID NO:190 and the cDNA sequence represented herein as SEQ ID NO:192. The CL02619 nucleic acid sequence encodes a 399 amino acid sequence, represented herein as SEQ ID NO:191. The signal peptide for CL02619 is located from positions 1 to about position 15 of SEQ ID NO:191, with the mature protein spanning from about position 16 to position 399 of SEQ ID NO:191. Within CL02619 is a catalytic domain (CD). The amino acid sequence containing the CD of CL02619 spans from a starting point of about position 26 of SEQ ID NO:191 to an ending point of about position 394 of SEQ ID NO:191. Based on homology, CL02619 can be assigned to CAZy Family GH 76. CL02619 also possesses significant homology (about 28% from amino acids 119 to 335 of CL02619) with a mannan endo-1,6-α-mannosidase from *Lodderomyces elongisporus* NRRL YB-4239 (Genbank Accession No. XP_001528696) and significant homology (about 52% from amino acids 44 to 367 of CL02619) with a glycosyl hydrolase from *Metarhizium anisopliae* (Genbank Accession No. ABD49724). Based on these degrees of homology, CL02619 is expected to exhibit similar mannan endo-1,6-α-mannosidase and glycosyl hydrolase enzymatic activity.

The enzyme CL06776 is encoded by the nucleic acid sequence represented herein as SEQ ID NO:193 and the cDNA sequence represented herein as SEQ ID NO:195. The CL06776 nucleic acid sequence encodes a 417 amino acid sequence, represented herein as SEQ ID NO:194. The signal peptide for CL06776 is located from positions 1 to about position 21 of SEQ ID NO:194, with the mature protein spanning from about position 22 to position 417 of SEQ ID NO:194. Within CL06776 is a catalytic domain (CD). The amino acid sequence containing the CD of CL06776 spans from a starting point of about position 59 of SEQ ID NO:194 to an ending point of about position 417 of SEQ ID NO:194. Based on homology, CL06776 can be assigned to CAZy Family GH 76. CL06776 also possesses significant homology (about 25% from amino acids 93 to 377 of CL06776) with a mannan endo-1,6-α-mannosidase from *Lodderomyces elongisporus* NRRL YB-4239 (Genbank Accession No. EDK42968) and significant homology (about 44% from amino acids 93 to 415 of CL06776) with a glycosyl hydrolase from *Streptomyces avermitilis* MA-4680 (Genbank Accession No. NP_821802). Based on these degrees of homology, CL06776 is expected to exhibit similar mannan endo-1,6-α-mannosidase and glycosyl hydrolase enzymatic activity.

The enzyme Man5 is encoded by the nucleic acid sequence represented herein as SEQ ID NO:196 and the cDNA sequence represented herein as SEQ ID NO:198. The Man5 nucleic acid sequence encodes a 513 amino acid sequence, represented herein as SEQ ID NO:197. The signal peptide for Man5 is located from positions 1 to about position 21 of SEQ ID NO:197, with the mature protein spanning from about position 22 to position 513 of SEQ ID NO:197. Within Man5 is a catalytic domain (CD). The amino acid sequence containing the CD of Man5 spans from a starting point of about position 23 of SEQ ID NO:197 to an ending point of about position 402 of SEQ ID NO:197. Based on homology, Man5 can be assigned to CAZy Family GH 76. Man5 also possesses significant homology (about 52% from amino acids 51 to 453 of Man5) with a glycosyl hydrolase from *Aspergillus clavatus* NRRL 1 (Genbank Accession No. EAW08810) and significant homology (about 44% from amino acids 6 to 453 of Man5) with a mannosidase from *Saccharomyces cerevisiae* (Genbank Accession No. EDN59863. Based on these degrees of homology, Man5 is expected to exhibit similar glycosyl hydrolase and mannosidase enzymatic activity.

The enzyme Man4 is encoded by the nucleic acid sequence represented herein as SEQ ID NO:199 and the cDNA sequence represented herein as SEQ ID NO:201. The Man4 nucleic acid sequence encodes a 443 amino acid sequence, represented herein as SEQ ID NO:200. The signal peptide for Man4 is located from positions 1 to about position 19 of SEQ ID NO:200, with the mature protein spanning from about position 20 to position 443 of SEQ ID NO:200. Within Man4 is a catalytic domain (CD). The amino acid sequence containing the CD of Man4 spans from a starting point of about position 20 of SEQ ID NO:200 to an ending point of about position 389 of SEQ ID NO:200. Based on homology, Man4 can be assigned to CAZy Family GH 76. Man4 also possesses significant homology (about 52% from amino acids 19 to 443 of Man4) with a glycosyl hydrolase from *Aspergillus clavatus* NRRL 1 (Genbank Accession No. EAW08810) and significant homology (about 44% from amino acids 23 to 443 of Man4) with a mannosidase from *Saccharomyces cerevisiae* (Genbank Accession No. EDN59863. Based on these degrees of homology, Man4 is expected to exhibit similar glycosyl hydrolase and mannosidase enzymatic activity.

The enzyme Man6 is encoded by the nucleic acid sequence represented herein as SEQ ID NO:202 and the cDNA sequence represented herein as SEQ ID NO:204. The Man6 nucleic acid sequence encodes a 474 amino acid sequence, represented herein as SEQ ID NO:203. The signal peptide for Man6 is located from positions 1 to about position 30 of SEQ ID NO:203, with the mature protein spanning from about position 31 to position 474 of SEQ ID NO:203. Within Man6 is a catalytic domain (CD). The amino acid sequence containing the CD of Man6 spans from a starting point of about position 32 of SEQ ID NO:203 to an ending point of about position 421 of SEQ ID NO:203. Based on homology, Man6 can be assigned to CAZy Family GH 76. Man6 also possesses significant homology (about 42% from amino acids 39 to 470 of Man6) with a mannosidase from *Saccharomyces cerevisiae* (Genbank Accession No. EDN59863. Based on this degree of homology, Man6 is expected to exhibit similar mannosidase enzymatic activity.

The enzyme Man7 is encoded by the nucleic acid sequence represented herein as SEQ ID NO:91 and the cDNA sequence represented herein as SEQ ID NO:93. The Man7 nucleic acid sequence encodes a 454 amino acid sequence, represented herein as SEQ ID NO:92. The signal peptide for Man7 is located from positions 1 to about position 19 of SEQ ID NO:92, with the mature protein spanning from about position 20 to position 454 of SEQ ID NO:92. Within Man7 is a catalytic domain (CD). The amino acid sequence containing the CD of Man7 spans from a starting point of about position 20 of SEQ ID NO:92 to an ending point of about position 400 of SEQ ID NO:92. Based on homology, Man7 can be assigned to CAZy Family GH 76. Man7 also possesses significant homology (about 51% from amino acids 50 to 450 of Man7) with a glycosyl hydrolase from *Aspergillus clavatus* NRRL 1 (Genbank Accession No. EAW08810) and significant homology (about 44% from amino acids 27 to 450 of Man7) with a mannosidase from *Saccharomyces cerevisiae* (Genbank Accession No. EDN59863. Based on these degrees of homology, Man7 is expected to exhibit similar glycosyl hydrolase and mannosidase enzymatic activity.

The enzyme Xgl1 is encoded by the nucleic acid sequence represented herein as SEQ ID NO:205 and the cDNA sequence represented herein as SEQ ID NO:207. The Xgl1 nucleic acid sequence encodes a 751 amino acid sequence, represented herein as SEQ ID NO:206. The signal peptide for Xgl1 is located from positions 1 to about position 22 of SEQ ID NO:206, with the mature protein spanning from about position 23 to position 751 of SEQ ID NO:206. Within Xgl1 is a catalytic domain (CD). The amino acid sequence containing the CD of Xgl1 spans from a starting point of about position 26 of SEQ ID NO:206 to an ending point of about position 708 of SEQ ID NO:206. Based on homology Xgl1 can be assigned to CAZy Family GH74. Xgl1 also possesses significant homology with the following enzymes: about 62.91% homology (from amino acids 26 to 751 of Xgl1) with the enzyme EGV endoglucanase from a fungal source (Genbank Accession No. ABJ18610) and about 59.92% homology (from amino acids 10 to 751) of Xgl1 with the hypothetical protein MG00582.4 from *Magnaporthe grisea* (Genbank Accession No. EAA48924). As evidenced below in Example 3, Xgl1 exhibits xyloglucanase activity.

The enzyme Agu1 is encoded by the nucleic acid sequence represented herein as SEQ ID NO:208 and the cDNA sequence represented herein as SEQ ID NO:210. The Agu1 nucleic acid sequence encodes a 878 amino acid sequence, represented herein as SEQ ID NO:209. The signal peptide for Agu1 is located from positions 1 to about position 17 of SEQ ID NO:209, with the mature protein spanning from about position 18 to position 878 of SEQ ID NO:209. Within Agu1 is a catalytic domain (CD). The amino acid sequence containing the CD of Agu1 spans from a starting point of about position 18 of SEQ ID NO:209 to an ending point of about position 763 of SEQ ID NO:209. Based on homology Agu1 can be assigned to CAZy Family GH67. Agu1 also possesses significant homology (about 71.23% homology from amino acids 3 to 876 of Agu1) with the hypothetical protein AN9286.2 from *Aspergillus nidulans* (Genbank Accession No. EAA66353) and (about 62% from amino acids 8 to 878 of Agu1) with an •-glucuronidase from *Aspergillus fumigatus* A1163 (Genbank Accession No. EDP52172). As evidenced below in Example 5, Agu1 exhibits •-glucuronidase activity.

The enzyme Abf3 is encoded by the nucleic acid sequence represented herein as SEQ ID NO:211 and the cDNA sequence represented herein as SEQ ID NO:213. The Abf3 nucleic acid sequence encodes a 654 amino acid sequence, represented herein as SEQ ID NO:212. The signal peptide for Abf3 is located from positions 1 to about position 18 of SEQ ID NO:212, with the mature protein spanning from about position 19 to position 654 of SEQ ID NO:212. Within Abf3 is a catalytic domain (CD). The amino acid sequence containing the CD of Abf3 spans from a starting point of about position 53 of SEQ ID NO:212 to an ending point of about position 645 of SEQ ID NO:212. Based on homology Agu1 can be assigned to CAZy Family GH51. Abf3 also possesses significant homology (about 53.23% from amino acids 4 to 649 of Abf3) with an unnamed protein product from *Aspergillus oryzae* (Genbank Accession No. BAE60499) and (about 53% from amino acids 4 to 653 of Abf3) with an •-L-arabinofuranosidase from *Neosartorya fischeri* (Genbank Accession No. EAW19083). As evidenced below in Examples 6 and 7, Abf3 exhibits arabinofuranosidase activity and •-glucosidase activity.

The enzyme Bxl1 is encoded by the nucleic acid sequence represented herein as SEQ ID NO:214 and the cDNA sequence represented herein as SEQ ID NO:216. The Bxl1 nucleic acid sequence encodes a 731 amino acid sequence, represented herein as SEQ ID NO:215. The signal peptide for Bxl1 is located from positions 1 to about position 21 of SEQ ID NO:215, with the mature protein spanning from about position 22 to position 731 of SEQ ID NO:215. Within Bxl1 is a catalytic domain (CD). The amino acid sequence containing the CD of Bxl1 spans from a starting point of about position 36 of SEQ ID NO:215 to an ending point of about position 591 of SEQ ID NO:215. Based on homology, Bxl1 can be assigned to CAZy Family GH3. Bxl1 also possesses significant homology (about 52.25% from amino acids 4 to 726 of Bxl1) with a protein related to xylan 1,4-beta-xylosidase from *Neurospora crassa* (Genbank Accession No. CAB91343.2). As evidenced below in Examples 8 and 22, Bxl1 exhibits •-xylosidase activity.

The enzyme Abf5 is encoded by the nucleic acid sequence represented herein as SEQ ID NO:217 and the cDNA sequence represented herein as SEQ ID NO:219. The Abf5 nucleic acid sequence encodes a 583 amino acid sequence, represented herein as SEQ ID NO:218. The signal peptide for Abf5 is located from positions 1 to about position 21 of SEQ ID NO:218, with the mature protein spanning from about position 22 of SEQ ID NO:218 to position 583 of SEQ ID NO:218. Within Abf5 is a catalytic domain (CD). The amino acid sequence containing the CD of Abf5 spans from a starting point of about position 38 to an ending point of about position 319 of SEQ ID NO:218. Based on homology, Abf5 can be assigned to CAZy Family GH43. Abf5 also possesses significant homology (about 53% from amino acids 42 to 571 of Abf5) with an enzyme from the glycosyl hydrolase family 43 from *Neosartoya fischeri* NRRL 181 (Genbank Accession No. EAW17743). As evidenced below in Examples 7 and 21, Abf5 exhibits arabinofuranosidase and β-glucosidase activity.

The enzyme Bga2 is encoded by the nucleic acid sequence represented herein as SEQ ID NO:220 and the cDNA sequence represented herein as SEQ ID NO:222. The Bga2 nucleic acid sequence encodes a 900 amino acid sequence, represented herein as SEQ ID NO:221. The signal peptide for Bga2 is located from positions 1 to about position 26 of SEQ ID NO:221, with the mature protein spanning from about position 27 to position 900 of SEQ ID NO:221. Within Bga2 is a catalytic domain (CD). The amino acid sequence containing the CD of Bga2 spans from a starting point of about position 106 of SEQ ID NO:221 to an ending point of about position 703 of SEQ ID NO:221. Bga2 also contains a GH2 sugar binding module; the amino acid sequence containing this domain spans from a starting point of about position 106 of SEQ ID NO:221 to an ending point of about position 243 of SEQ ID NO:221. Based on homology, Bga2 can be assigned to CAZy Family GH2. Bga2 also possesses significant homology (about 58% from amino acids 30 to 900 of Bga2) with a hypothetical protein from *Aspergillus nidulans* FGSC A4 (Genbank Accession No. EAA58410) and (about 54% from amino acids 3 to 900 of Bga2) with •-galactosidase from *Xanthomonas campestris* pv. *campestris* (Genbank Accession No. AAP86765). As evidenced below in Examples 9 and 18, Bga2 exhibits •-galactosidase activity.

The enzyme Cip1 is encoded by the nucleic acid sequence represented herein as SEQ ID NO:223 and the cDNA sequence represented herein as SEQ ID NO:225. The Cip1 nucleic acid sequence encodes a 236 amino acid sequence, represented herein as SEQ ID NO:224. The signal peptide for Cip1 is located from positions 1 to about position 18 of SEQ ID NO:224, with the mature protein spanning from about position 19 to position 236 of SEQ ID NO:224. Within Cip1 is a catalytic domain (CD). The amino acid sequence containing the CD of Cip1 spans from a starting point of about position 19 of SEQ ID NO:224 to an ending point of about position 236 of SEQ ID NO:227. Based on homology, Cip1 can be assigned to CAZy Family CBM1. Cip1 also possesses significant homology (about 80% from amino acids 1 to 236 of Cip1) with a hypothetical protein from *Chaetomium globosum* (Genbank Accession No. EAQ87122) and (about 67% from amino acids 1 to 235 of Cip1) with Cip1 from *Hypocrea jecorina* (Genbank Accession No. AAP57751). As evidenced below in Example 4, Cip1 binds to bacitracin sepharose column, indicating that it contains a carbohydrate binding module.

The enzyme Axe3 is encoded by the nucleic acid sequence represented herein as SEQ ID NO:226 and the cDNA sequence represented herein as SEQ ID NO:228. The Axe3 nucleic acid sequence encodes a 313 amino acid sequence, represented herein as SEQ ID NO:227. The signal peptide for Axe3 is located from position 1 to about position 21 of SEQ ID NO:227, with the mature protein spanning from about position 22 to position 313 of SEQ ID NO:227. Within Axe3 is a catalytic domain (CD). The amino acid sequence containing the CD of Axe3 spans from a starting point of about position 22 of SEQ ID NO:227 to an ending point of about position 255 of SEQ ID NO:227. Based on homology, Axe3 can be assigned to CAZy families of CE1 and CBM1. Axe3 also possesses significant homology (about 69.85% from amino acids 41 to 312 of Axe3) with acetyl xylan esterase from *Penicillium purpurogenum* (Genbank Accession No. AAM93261.1). As evidenced below in Examples 19 and 20, Axe3 possesses acetyl xylan esterase activity.

The enzyme Axe2 is encoded by the nucleic acid sequence represented herein as SEQ ID NO:229 and the cDNA sequence represented herein as SEQ ID NO:231. The Axe2 nucleic acid sequence encodes a 228 amino acid sequence, represented herein as SEQ ID NO:230. The signal peptide for Axe2 is located from positions 1 to about position 17 of SEQ ID NO:230, with the mature protein spanning from about position 18 to position 228 of SEQ ID NO:230. Within Axe2 is a catalytic domain (CD). The amino acid sequence containing the CD of Axe2 spans from a starting point of about position 26 of SEQ ID NO:230 to an ending point of about position 228 of SEQ ID NO:230. Based on homology, Axe2 can be assigned to CAZy families of CE5 and CBM1. Axe2 also possesses significant homology (about 67.62% from amino acids 1 to 225 of Axe2) with a hypothetical protein from *Magnaporthe grisea* (Genbank Accession No. XP_368098) and (about 56.85% from amino acids 14 to 225 of Axe2) with acetyl xylan esterase from *Neurospora crassa* (Genbank Accession No. CAD70564.1). As evidenced below in Examples 19 and 20, Axe2 possesses acetyl xylan esterase activity.

The enzyme Bxl2 is encoded by the nucleic acid sequence represented herein as SEQ ID NO:232 and the cDNA sequence represented herein as SEQ ID NO:234. The Bxl2 nucleic acid sequence encodes a 733 amino acid sequence, represented herein as SEQ ID NO:233. The signal peptide for Bxl2 is located from positions 1 to about position 17 of SEQ ID NO:233, with the mature protein spanning from about position 18 to position 733 of SEQ ID NO:233. Within Bxl2 is a catalytic domain (CD). The amino acid sequence containing the CD of Bxl2 spans from a starting point of about position 26 of SEQ ID NO:233 to an ending point of about position 602 of SEQ ID NO:233. Based on homology, Bxl2 can be assigned to CAZy families of CBM1 and GH3. Bxl2 also possesses significant homology (about 54.33% from amino acids 34 to 730 of Bxl2) with beta-glucosidase from *Phanerochaete chrysosporium* (Genbank Accession No. BAB85988.1) and (about 72.22% from amino acids 34 to 733 of Bxl2) with a hypothetical protein MGG_09353 from *Magnaporthe grisea* 70-15 (Genbank Accession No. XP_364573.1). As evidenced below in Examples 21, Bxl2 possesses •-glucosidase activity.

Physical properties of enzymes of the present invention are illustrated in Table 1 below, including the molecular weigh and isoelectric point, as calculated from the primary amino acid sequence using the ProtParam program (available at the ExPASy Proteomics Server).

TABLE 1

Physical Properties of C1 Enzymes

| Enzyme | SEQ ID NO: | MW (kDa) | pI |
|---|---|---|---|
| CDH1 | 2 | 85.2 | 5.44 |
| CDH1 (observed) | 2 | 91 | 4.5 |
| FaeB1 | 5 | 31.68 | 6.87 |
| Rga1 | 8 | 25.99 | 5.42 |
| Rga1 (observed) | 8 | 30 | |
| Gln | 11 | 51.26 | 5.71 |
| Abn2 | 14 | 40.05 | 4.89 |
| Abn3 | 17 | 35.92 | 5.12 |
| Abn4 | 20 | 33.15 | 4.71 |
| Abn4 (observed) | 20 | 35 | |
| Abn5 | 23 | 47.32 | 5.1 |
| Abn7 | 26 | 59.24 | 4.71 |
| Abn7 (observed) | 26 | 70 | |
| Pec11 | 74 | 37.86 | 4.83 |
| Pec12 | 77 | 33.72 | 5.67 |
| Pec13 | 80 | 45.10 | 6.19 |
| Pec14 | 83 | 33.33 | 5.68 |
| Pec15 | 86 | 26.21 | 5.21 |
| Rgl1 | 89 | 58.75 | 7.26 |
| Bxl4 | 110 | 61.23 | 5.83 |
| Abn9 | 113 | 37.12 | 4.69 |
| Pgx1 | 161 | 52.03 | 6.33 |
| Rgx1 | 164 | 46.14 | 5.96 |
| Abf4 | 185 | 57.68 | 5.75 |
| Xgl1 | 206 | 76.62 | 4.42 |
| Agu1 | 209 | 96.5 | 5.82 |
| Agu1 (observed) | 209 | 90 | 5.5 |

TABLE 1-continued

Physical Properties of C1 Enzymes

| Enzyme | SEQ ID NO: | MW (kDa) | pI |
|---|---|---|---|
| Abf3 | 212 | 69.61 | 5.75 |
| Bxl1 | 215 | 76.49 | 5.38 |
| Abf5 | 218 | 61.23 | 4.58 |
| Bga2 | 221 | 96.29 | 6.35 |
| Cip1 | 224 | 23.50 | 4.25 |
| Axe3 | 227 | 31.58 | 6.21 |
| Axe3 (observed) | 227 | 31.5 | 5.38 |
| Axe2 | 230 | 21.99 | 5.31 |
| Axe2 (observed) | 230 | 22.3 | 3.71 |
| Bxl2 | 233 | 75.89 | 4.80 |

MW = Molecular Weight in kiloDaltons (kDa), as calculated based on amino acid sequence with Clone Manager 9 Professional Edition
pI = isoelectric point, as calculated based on amino acid sequence with Clone Manager 9 Professional Edition As used herein, reference to an isolated protein or polypeptide in the present invention, including any of the enzymes disclosed herein, includes full-length proteins, fusion proteins, or any fragment or homologue of such a protein. More specifically, an isolated protein, such as an enzyme according to the present invention, is a protein (including a polypeptide or peptide) that has been removed from its natural milieu (i.e., that has been subject to human manipulation) and can include purified proteins, partially purified proteins, recombinantly produced proteins, synthetically produced proteins, proteins complexed with lipids, soluble proteins, and isolated proteins associated with other proteins, for example. As such, "isolated" does not reflect the extent to which the protein has been purified. Preferably, an isolated protein of the present invention is produced recombinantly. In addition, and by way of example, a "*C. lucknowens* protein" or "*C. lucknowens* enzyme" refers to a protein (generally including a homologue of a naturally occurring protein) from *Chrysosporium lucknowense* or to a protein that has been otherwise produced from the knowledge of the structure (e.g., sequence) and perhaps the function of a naturally occurring protein from *Chrysosporium lucknowense*. In other words, a *C. lucknowens* protein includes any protein that has substantially similar structure and function of a naturally occurring *C. lucknowens* protein or that is a biologically active (i.e., has biological activity) homologue of a naturally occurring protein from *C. lucknowens* as described in detail herein. As such, a *C. lucknowens* protein can include purified, partially purified, recombinant, mutated/modified and synthetic proteins. According to the present invention, the terms "modification" and "mutation" can be used interchangeably, particularly with regard to the modifications/mutations to the amino acid sequence of a *C. lucknowens* protein (or nucleic acid sequences) described herein. An isolated protein according to the present invention can be isolated from its natural source, produced recombinantly or produced synthetically.

According to the present invention, the terms "modification" and "mutation" can be used interchangeably, particularly with regard to the modifications/mutations to the primary amino acid sequences of a protein or peptide (or nucleic acid sequences) described herein. The term "modification" can also be used to describe post-translational modifications to a protein or peptide including, but not limited to, methylation, farnesylation, carboxymethylation, geranyl geranylation, glycosylation, phosphorylation, acetylation, myristoylation, prenylation, palmitation, and/or amidation. Modifications can also include, for example, complexing a protein or peptide with another compound. Such modifications can be considered to be mutations, for example, if the modification is different than the post-translational modification that occurs in the natural, wild-type protein or peptide.

As used herein, the term "homologue" is used to refer to a protein or peptide which differs from a naturally occurring protein or peptide (i.e., the "prototype" or "wild-type" protein) by minor modifications to the naturally occurring protein or peptide, but which maintains the basic protein and side chain structure of the naturally occurring form. Such changes include, but are not limited to: changes in one or a few amino acid side chains; changes one or a few amino acids, including deletions (e.g., a truncated version of the protein or peptide), insertions and/or substitutions; changes in stereochemistry of one or a few atoms; and/or minor derivatizations, including but not limited to: methylation, glycosylation, phosphorylation, acetylation, myristoylation, prenylation, palmitation, amidation and/or addition of glycosylphosphatidyl inositol. A homologue can have either enhanced, decreased, or substantially similar properties as compared to the naturally occurring protein or peptide. A homologue can include an agonist of a protein or an antagonist of a protein.

Homologues can be the result of natural allelic variation or natural mutation. A naturally occurring allelic variant of a nucleic acid encoding a protein is a gene that occurs at essentially the same locus (or loci) in the genome as the gene which encodes such protein, but which, due to natural variations caused by, for example, mutation or recombination, has a similar but not identical sequence. Allelic variants typically encode proteins having similar activity to that of the protein encoded by the gene to which they are being compared. One class of allelic variants can encode the same protein but have different nucleic acid sequences due to the degeneracy of the genetic code. Allelic variants can also comprise alterations in the 5' or 3' untranslated regions of the gene (e.g., in regulatory control regions). Allelic variants are well known to those skilled in the art.

Homologues can be produced using techniques known in the art for the production of proteins including, but not limited to, direct modifications to the isolated, naturally occurring protein, direct protein synthesis, or modifications to the nucleic acid sequence encoding the protein using, for example, classic or recombinant DNA techniques to effect random or targeted mutagenesis.

Modifications in protein homologues, as compared to the wild-type protein, either agonize, antagonize, or do not substantially change, the basic biological activity of the homologue as compared to the naturally occurring protein. Modifications of a protein, such as in a homologue, may result in proteins having the same biological activity as the naturally occurring protein, or in proteins having decreased or increased biological activity as compared to the naturally occurring protein. Modifications which result in a decrease in protein expression or a decrease in the activity of the protein, can be referred to as inactivation (complete or partial), down-regulation, or decreased action of a protein. Similarly, modifications which result in an increase in protein expression or an increase in the activity of the protein, can be referred to as amplification, overproduction, activation, enhancement, up-regulation or increased action of a protein.

According to the present invention, an isolated protein, including a biologically active homologue or fragment thereof, has at least one characteristic of biological activity of a wild-type, or naturally occurring, protein. As discussed above, in general, the biological activity or biological action of a protein refers to any function(s) exhibited or performed by the protein that is ascribed to the naturally occurring form of the protein as measured or observed in vivo (i.e., in the natural physiological environment of the protein) or in vitro (i.e., under laboratory conditions). The biological activity of a protein of the present invention can include an enzyme activity (catalytic activity and/or substrate binding activity), such as cellulase activity, hemicellulase activity, β-glucanase activity, β-glucosidase activity, α-galactosidase activity, β-galactosidase activity, xylanase activity or any other activity disclosed herein. Specific biological activities of the proteins disclosed herein are described in detail above and in the Examples. Methods of detecting and measuring the biological activity of a protein of the invention include, but are not limited to, the assays described in the Examples section below. Such assays include, but are not limited to, measurement of enzyme activity (e.g., catalytic activity), measurement of substrate binding, and the like. It is noted that an isolated protein of the present invention (including homologues) is not required to have a biological activity such as catalytic activity. A protein can be a truncated, mutated or inactive protein, or lack at least one activity of the wild-type enzyme, for example. Inactive proteins may be useful in some screening assays, for example, or for other purposes such as antibody production.

Methods to measure protein expression levels of a protein according to the invention include, but are not limited to: western blotting, immunocytochemistry, flow cytometry or other immunologic-based assays; assays based on a property of the protein including but not limited to, ligand binding or interaction with other protein partners. Binding assays are also well known in the art. For example, a BIAcore machine can be used to determine the binding constant of a complex between two proteins. The dissociation constant for the complex can be determined by monitoring changes in the refractive index with respect to time as buffer is passed over the chip (O'Shannessy et al. Anal. Biochem. 212:457-468 (1993); Schuster et al., Nature 365:343-347 (1993)). Other suitable assays for measuring the binding of one protein to another include, for example, immunoassays such as enzyme linked immunoabsorbent assays (ELISA) and radioimmunoassays (RIA), or determination of binding by monitoring the change in the spectroscopic or optical properties of the proteins through fluorescence, UV absorption, circular dichrosim, or nuclear magnetic resonance (NMR).

Many of the enzymes and proteins of the present invention may be desirable targets for modification and use in the processes described herein. These proteins have been described in terms of function and amino acid sequence (and nucleic acid sequence encoding the same) of representative wild-type proteins. In one embodiment of the invention, homologues of a given protein (which can include related proteins from other organisms or modified forms of the given protein) are encompassed for use in the invention. Homologues of a protein encompassed by the present invention can comprise, consist essentially of, or consist of, in one embodiment, an amino acid sequence that is at least about 35% identical, and more preferably at least about 40% identical, and more preferably at least about 45% identical, and more preferably at least about 50% identical, and more preferably at least about 55% identical, and more preferably at least about 60% identical, and more preferably at least about 65% identical, and more preferably at least about 70% identical, and more preferably at least about 75% identical, and more preferably at least about 80% identical, and more preferably at least about 85% identical, and more preferably at least about 90% identical, and more preferably at least about 95% identical, and more preferably at least about 96% identical, and more preferably at least about 97% identical, and more preferably at least about 98% identical, and more preferably at least about 99% identical, or any percent identity between 35% and 99%, in whole integers (i.e., 36%, 37%, etc.), to an amino acid sequence disclosed herein that represents the amino acid sequence of an enzyme or protein according to the invention (including a biologically active domain of a full-length protein). Preferably, the amino acid sequence of the homologue has a biological activity of the wild-type or reference protein or of a biologically active domain thereof (e.g., a catalytic domain).

In one embodiment, a protein of the present invention comprises, consists essentially of, or consists of an amino acid sequence that, alone or in combination with other characteristics of such proteins disclosed herein, is less than 100% identical to an amino acid sequence selected from: SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, or SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233 (i.e., a homologue). For example, a protein of the present invention can be less than 100% identical, in combination with being at least about 35% identical, to a given disclosed sequence. In another aspect of the invention, a homologue according to the present invention has an amino acid sequence that is less than about 99% identical to any of such amino acid sequences, and in another embodiment, is less than about 98% identical to any of such amino acid sequences, and in another embodiment, is less than about 97% identical to any of such amino acid sequences, and in another embodiment, is less than about 96% identical to any of such amino acid sequences, and in another embodiment, is less than about 95% identical to any of such amino acid sequences, and in another embodiment, is less than about 94% identical to any of such amino acid sequences, and in another embodiment, is less than about 93% identical to any of such amino acid sequences, and in another embodiment, is less than about 92% identical to any of such amino acid sequences, and in another embodiment, is less than about 91% identical to any of such amino acid sequences, and in another embodiment, is less than about 90% identical to any of such amino acid sequences, and so on, in increments of whole integers.

As used herein, unless otherwise specified, reference to a percent (%) identity refers to an evaluation of homology which is performed using: (1) a BLAST 2.0 Basic BLAST homology search using blastp for amino acid searches and blastn for nucleic acid searches with standard default parameters, wherein the query sequence is filtered for low complexity regions by default (described in Altschul, S. F., Madden, T. L., Schääffer, A. A., Zhang, J., Zhang, Z., Miller, W. & Lipman, D. J. (1997) "Gapped BLAST and PSI-BLAST: a new generation of protein database search programs." Nucleic Acids Res. 25:3389-3402, incorporated herein by reference in its entirety); (2) a BLAST 2 alignment (using the parameters described below); (3) PSI-BLAST with the standard default parameters (Position-Specific Iterated BLAST; and/or (4) CAZy homology determined using standard default parameters from the Carbohydrate Active EnZymes database (Coutinho, P. M. & Henrissat, B. (1999) Carbohydrate-active enzymes: an integrated database approach. In "Recent Advances in Carbohydrate Bioengineering", H. J. Gilbert, G. Davies, B. Henrissat and B. Svensson eds., The Royal Society of Chemistry, Cambridge, pp. 3-12).

It is noted that due to some differences in the standard parameters between BLAST 2.0 Basic BLAST and BLAST 2, two specific sequences might be recognized as having significant homology using the BLAST 2 program, whereas a search performed in BLAST 2.0 Basic BLAST using one of the sequences as the query sequence may not identify the second sequence in the top matches. In addition, PSI-BLAST provides an automated, easy-to-use version of a "profile" search, which is a sensitive way to look for sequence homologues. The program first performs a gapped BLAST database search. The PSI-BLAST program uses the information from any significant alignments returned to construct a position-specific score matrix, which replaces the query sequence for the next round of database searching. Therefore, it is to be understood that percent identity can be determined by using any one of these programs.

Two specific sequences can be aligned to one another using BLAST 2 sequence as described in Tatusova and Madden, (1999), "Blast 2 sequences—a new tool for comparing protein and nucleotide sequences", *FEMS Microbiol Lett.* 174: 247-250, incorporated herein by reference in its entirety. BLAST 2 sequence alignment is performed in blastp or blastn using the BLAST 2.0 algorithm to perform a Gapped BLAST search (BLAST 2.0) between the two sequences allowing for the introduction of gaps (deletions and insertions) in the resulting alignment. For purposes of clarity herein, a BLAST 2 sequence alignment is performed using the standard default parameters as follows.

For blastn, using 0 BLOSUM62 matrix:
  Reward for match=1
  Penalty for mismatch=−2
  Open gap (5) and extension gap (2) penalties
  gap x_dropoff (50) expect (10) word size (11) filter (on)
For blastp, using 0 BLOSUM62 matrix:
  Open gap (11) and extension gap (1) penalties
  gap x_dropoff (50) expect (10) word size (3) filter (on).

A protein of the present invention can also include proteins having an amino acid sequence comprising at least 10 contiguous amino acid residues of any of the sequences described herein (i.e., 10 contiguous amino acid residues having 100% identity with 10 contiguous amino acids of SEQ ID NO:2). In other embodiments, a homologue of a protein amino acid sequence includes amino acid sequences comprising at least 20, or at least 30, or at least 40, or at least 50, or at least 75, or at least 100, or at least 125, or at least 150, or at least 175, or at least 150, or at least 200, or at least 250, or at least 300, or at least 350 contiguous amino acid residues of any of the amino acid sequence represented disclosed herein. Even small fragments of proteins without biological activity are useful in the present invention, for example, in the preparation of antibodies against the full-length protein or in a screening assay (e.g., a binding assay). Fragments can also be used to construct fusion proteins, for example, where the fusion protein comprises functional domains from two or more different proteins (e.g., a CBM from one protein linked to a CD from another protein). In one embodiment, a homologue has a measurable or detectable biological activity associated with the wild-type protein (e.g., enzymatic activity).

According to the present invention, the term "contiguous" or "consecutive", with regard to nucleic acid or amino acid sequences described herein, means to be connected in an unbroken sequence. For example, for a first sequence to comprise 30 contiguous (or consecutive) amino acids of a second sequence, means that the first sequence includes an unbroken sequence of 30 amino acid residues that is 100% identical to an unbroken sequence of 30 amino acid residues in the second sequence. Similarly, for a first sequence to have "100% identity" with a second sequence means that the first sequence exactly matches the second sequence with no gaps between nucleotides or amino acids.

In another embodiment, a protein of the present invention, including a homologue, includes a protein having an amino acid sequence that is sufficiently similar to a natural amino acid sequence that a nucleic acid sequence encoding the homologue is capable of hybridizing under moderate, high or very high stringency conditions (described below) to (i.e., with) a nucleic acid molecule encoding the natural protein (i.e., to the complement of the nucleic acid strand encoding the natural amino acid sequence). Preferably, a homologue of a protein of the present invention is encoded by a nucleic acid molecule comprising a nucleic acid sequence that hybridizes under low, moderate, or high stringency conditions to the complement of a nucleic acid sequence that encodes a protein comprising, consisting essentially of, or consisting of, an amino acid sequence represented by any of: SEQ ID NO:2, SEQ ID NO:5, SEQ ID NO:8, SEQ ID NO:1, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, or SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233. Such hybridization conditions are described in detail below.

A nucleic acid sequence complement of nucleic acid sequence encoding a protein of the present invention refers to the nucleic acid sequence of the nucleic acid strand that is complementary to the strand which encodes the protein. It will be appreciated that a double stranded DNA which encodes a given amino acid sequence comprises a single strand DNA and its complementary strand having a sequence that is a complement to the single strand DNA. As such, nucleic acid molecules of the present invention can be either double-stranded or single-stranded, and include those nucleic acid molecules that form stable hybrids under stringent hybridization conditions with a nucleic acid sequence that encodes an amino acid sequence such as SEQ ID NO:2, and/or with the complement of the nucleic acid sequence that encodes an amino acid sequence such as SEQ ID NO:2. Methods to deduce a complementary sequence are known to those skilled in the art. It should be noted that since nucleic acid sequencing technologies are not entirely error-free, the sequences presented herein, at best, represent apparent sequences of the proteins of the present invention.

As used herein, reference to hybridization conditions refers to standard hybridization conditions under which nucleic acid molecules are used to identify similar nucleic acid molecules. Such standard conditions are disclosed, for example, in Sambrook et al., *Molecular Cloning: A Laboratory Manual*, Cold Spring Harbor Labs Press, 1989. Sambrook et al., ibid., is incorporated by reference herein in its entirety (see specifically, pages 9.31-9.62). In addition, formulae to calculate the appropriate hybridization and wash conditions to achieve hybridization permitting varying degrees of mismatch of nucleotides are disclosed, for example, in Meinkoth et al., 1984, *Anal. Biochem.* 138, 267-284; Meinkoth et al., ibid., is incorporated by reference herein in its entirety.

More particularly, moderate stringency hybridization and washing conditions, as referred to herein, refer to conditions which permit isolation of nucleic acid molecules having at least about 70% nucleic acid sequence identity with the nucleic acid molecule being used to probe in the hybridization reaction (i.e., conditions permitting about 30% or less mismatch of nucleotides). High stringency hybridization and washing conditions, as referred to herein, refer to conditions which permit isolation of nucleic acid molecules having at least about 80% nucleic acid sequence identity with the nucleic acid molecule being used to probe in the hybridization reaction (i.e., conditions permitting about 20% or less mismatch of nucleotides). Very high stringency hybridization and washing conditions, as referred to herein, refer to conditions which permit isolation of nucleic acid molecules having at least about 90% nucleic acid sequence identity with the nucleic acid molecule being used to probe in the hybridization reaction (i.e., conditions permitting about 10% or less mismatch of nucleotides). As discussed above, one of skill in the art can use the formulae in Meinkoth et al., ibid. to calculate the appropriate hybridization and wash conditions to achieve these particular levels of nucleotide mismatch. Such conditions will vary, depending on whether DNA:RNA or DNA:DNA hybrids are being formed. Calculated melting temperatures for DNA:DNA hybrids are 10° C. less than for DNA:RNA hybrids. In particular embodiments, stringent hybridization conditions for DNA:DNA hybrids include hybridization at an ionic strength of 6×SSC (0.9 M $Na^+$) at a temperature of between about 20° C. and about 35° C. (lower stringency), more preferably, between about 28° C. and about 40° C. (more stringent), and even more preferably, between about 35° C. and about 45° C. (even more stringent), with appropriate wash conditions. In particular embodiments, stringent hybridization conditions for DNA:RNA hybrids include hybridization at an ionic strength of 6×SSC (0.9 M $Na^+$) at a temperature of between about 30° C. and about 45° C., more preferably, between about 38° C. and about 50° C., and even more preferably, between about 45° C. and about 55° C., with similarly stringent wash conditions. These values are based on calculations of a melting temperature for molecules larger than about 100 nucleotides, 0% formamide and a G+C content of about 40%. Alternatively, $T_m$ can be calculated empirically as set forth in Sambrook et al., supra, pages 9.31 to 9.62. In general, the wash conditions should be as stringent as possible, and should be appropriate for the chosen hybridization conditions. For example, hybridization conditions can include a combination of salt and temperature conditions that are approximately 20-25° C. below the calculated $T_m$ of a particular hybrid, and wash conditions typically include a combination of salt and temperature conditions that are approximately 12-20° C. below the calculated $T_m$ of the particular hybrid. One example of hybridization conditions suitable for use with DNA:DNA hybrids includes a 2-24 hour hybridization in 6×SSC (50% formamide) at about 42° C., followed by washing steps that include one or more washes at room temperature in about 2×SSC, followed by additional washes at higher temperatures and lower ionic strength (e.g., at least one wash as about 37° C. in about 0.1×-0.5×SSC, followed by at least one wash at about 68° C. in about 0.1×-0.5×SSC).

The minimum size of a protein and/or homologue of the present invention is a size sufficient to have biological activity or, when the protein is not required to have such activity, sufficient to be useful for another purpose associated with a protein of the present invention, such as for the production of antibodies that bind to a naturally occurring protein. In one embodiment, the protein of the present invention is at least 20 amino acids in length, or at least about 25 amino acids in length, or at least about 30 amino acids in length, or at least about 40 amino acids in length, or at least about 50 amino acids in length, or at least about 60 amino acids in length, or at least about 70 amino acids in length, or at least about 80 amino acids in length, or at least about 90 amino acids in length, or at least about 100 amino acids in length, or at least about 125 amino acids in length, or at least about 150 amino acids in length, or at least about 175 amino acids in length, or at least about 200 amino acids in length, or at least about 250 amino acids in length, and so on up to a full length of each protein, and including any size in between in increments of one whole integer (one amino acid). There is no limit, other than a practical limit, on the maximum size of such a protein in that the protein can include a portion of a protein or a full-length protein, plus additional sequence (e.g., a fusion protein sequence), if desired.

The present invention also includes a fusion protein that includes a domain of a protein of the present invention (including a homologue) attached to one or more fusion segments, which are typically heterologous in sequence to the protein sequence (i.e., different than protein sequence). Suitable fusion segments for use with the present invention include, but are not limited to, segments that can: enhance a protein's stability; provide other desirable biological activity; and/or assist with the purification of the protein (e.g., by affinity chromatography). A suitable fusion segment can be a domain of any size that has the desired function (e.g., imparts increased stability, solubility, action or biological activity; and/or simplifies purification of a protein). Fusion segments can be joined to amino and/or carboxyl termini of the domain of a protein of the present invention and can be susceptible to cleavage in order to enable straight-forward recovery of the protein. Fusion proteins are preferably produced by culturing a recombinant cell transfected with a fusion nucleic acid molecule that encodes a protein including the fusion segment attached to either the carboxyl and/or amino terminal end of a domain of a protein of the present invention. Accordingly, proteins of the present invention also include expression products of gene fusions (for example, used to overexpress soluble, active forms of the recombinant protein), of mutagenized genes (such as genes having codon modifications to enhance gene transcription and translation), and of truncated genes (such as genes having membrane binding modules removed to generate soluble forms of a membrane protein, or genes having signal sequences removed which are poorly tolerated in a particular recombinant host).

In one embodiment of the present invention, any of the amino acid sequences described herein can be produced with from at least one, and up to about 20, additional heterologous amino acids flanking each of the C- and/or N-terminal ends of the specified amino acid sequence. The resulting protein or polypeptide can be referred to as "consisting essentially of" the specified amino acid sequence. According to the present invention, the heterologous amino acids are a sequence of amino acids that are not naturally found (i.e., not found in nature, in vivo) flanking the specified amino acid sequence, or that are not related to the function of the specified amino acid sequence, or that would not be encoded by the nucleotides that flank the naturally occurring nucleic acid sequence encoding the specified amino acid sequence as it occurs in the gene, if such nucleotides in the naturally occurring sequence were translated using standard codon usage for the organism from which the given amino acid sequence is derived.

The present invention also provides enzyme combinations that break down lignocellulose material. Such enzyme combinations or mixtures can include a multi-enzyme composition that contains at least one protein of the present invention in combination with one or more additional proteins of the present invention or one or more enzymes or other proteins from other microorganisms, plants, or similar organisms. Synergistic enzyme combinations and related methods are contemplated. The invention includes methods to identify the optimum ratios and compositions of enzymes with which to degrade each lignocellulosic material. These methods entail tests to identify the optimum enzyme composition and ratios for efficient conversion of any lignocellulosic substrate to its constituent sugars. The Examples below include assays that may be used to identify optimum ratios and compositions of enzymes with which to degrade lignocellulosic materials.

Any combination of the proteins disclosed herein is suitable for use in the multi-enzyme compositions of the present invention. Due to the complex nature of most biomass sources, which can contain cellulose, hemicellulose, pectin, lignin, protein, and ash, among other components, preferred enzyme combinations may contain enzymes with a range of substrate specificities that work together to degrade biomass into fermentable sugars in the most efficient manner. One example of a multi-enzyme complex for lignocellulose saccharification is a mixture of cellobiohydrolase(s), xylanase(s), endoglucanase(s), β-glucosidase(s), β-xylosidase(s), and accessory enzymes. However, it is to be understood that any of the enzymes described specifically herein can be combined with any one or more of the enzymes described herein or with any other available and suitable enzymes, to produce a multi-enzyme composition. The invention is not restricted or limited to the specific exemplary combinations listed below.

In one embodiment, the cellobiohydrolase(s) comprise between about 30% and about 90% or between about 40% and about 70% of the enzymes in the composition, and more preferably, between about 55% and 65%, and more preferably, about 60% of the enzymes in the composition (including any percentage between 40% and 70% in 0.5% increments (e.g., 40%, 40.5%, 41%, etc.).

In one embodiment, the xylanase(s) comprise between about 10% and about 30% of the enzymes in the composition, and more preferably, between about 15% and about 25%, and more preferably, about 20% of the enzymes in the composition (including any percentage between 10% and 30% in 0.5% increments).

In one embodiment, the endoglucanase(s) comprise between about 5% and about 15% of the enzymes in the composition, and more preferably, between about 7% and about 13%, and more preferably, about 10% of the enzymes in the composition (including any percentage between 5% and 15% in 0.5% increments).

In one embodiment, the β-glucosidase(s) comprise between about 1% and about 15% of the enzymes in the composition, and preferably between about 2% and 10%, and more preferably, about 3% of the enzymes in the composition (including any percentage between 1% and 15% in 0.5% increments).

In one embodiment, the β-xylosidase(s) comprise between about 1% and about 3% of the enzymes in the composition, and preferably, between about 1.5% and about 2.5%, and more preferably, about 2% of the enzymes in the composition (including any percentage between 1% and 3% in 0.5% increments.

In one embodiment, the accessory enzymes comprise between about 2% and about 8% of the enzymes in the composition, and preferably, between about 3% and about 7%, and more preferably, about 5% of the enzymes in the composition (including any percentage between 2% and 8% in 0.5% increments.

One particularly preferred example of a multi-enzyme complex for lignocellulose saccharification is a mixture of about 60% cellobiohydrolase(s), about 20% xylanase(s), about 10% endoglucanase(s), about 3% β-glucosidase(s), about 2% β-xylosidase(s) and about 5% accessory enzyme(s).

Enzymes and multi-enzyme compositions of the present invention may also be used to break down arabinoxylan or arabinoxylan-containing substrates. Arabinoxylan is a polysaccharide composed of xylose and arabinose, wherein α-L-arabinofuranose residues are attached as branch-points to a β-(1,4)-linked xylose polymeric backbone. The xylose residues may be mono-substituted at the C2 or C3 position, or di-substituted at both positions. Ferulic acid or coumaric acid may also be ester-linked to the C5 position of arabinosyl residues. Further details on the hydrolysis of arabinoxylan can be found in International Publication No. WO 2006/114095, the contents of which are incorporated herein by reference.

The substitutions on the xylan backbone can inhibit the enzymatic activity of xylanases, and the complete hydrolysis of arabinoxylan typically requires the action of several different enzymes. One example of a multi-enzyme complex for arabinoxylan hydrolysis is a mixture of endoxylanase(s), β-xylosidase(s), and arabinofuranosidase(s), including those with specificity towards single and double substituted xylose residues. In some embodiments, the multi-enzyme complex may further comprise one or more carbohydrate esterases, such as acetyl xylan esterases, ferulic acid esterases, coumaric acid esterases or pectin methyl esterases. Any combination of two or more of the above-mentioned enzymes is suitable for use in the multi-enzyme complexes. However, it is to be understood that the invention is not restricted or limited to the specific exemplary combinations listed herein.

In one embodiment, the endoxylanase(s) comprise at least about 5%, at least about 10%, at least about 15%, at least about 20%, at least about 25%, at least about 30%, at least about 40%, at least about 50%, at least about 70% of the enzymes in the composition (including any percentage between 5% and 70% in 0.5% increments (e.g., 5.0%, 5.5%, 6.0%, etc.). Endoxylanase(s), either alone or as part of a multi-enzyme complex, may be used in amounts of 0.001 to 2.0 g/kg, 0.005 to 1.0 g/kg, or 0.05 to 0.2 g/kg of substrate.

In one embodiment, the β-xylosidase(s) comprise at least about 5%, at least about 10%, at least about 15%, at least about 20%, at least about 25%, at least about 30%, at least about 40%, at least about 50%, at least about 70% of the enzymes in the composition (including any percentage between 5% and 70% in 0.5% increments (e.g., 5.0%, 5.5%, 6.0%, etc.). β-xylosidase(s), either alone or as part of a multi-enzyme complex, may be used in amounts of 0.001 to 2.0 g/kg, 0.005 to 1.0 g/kg, or 0.05 to 0.2 g/kg of substrate.

In one embodiment, the arabinofuranosidase(s) comprise at least about 5%, at least about 10%, at least about 15%, at least about 20%, at least about 25%, at least about 30%, at least about 40%, at least about 50%, at least about 70% of the enzymes in the composition (including any percentage between 5% and 70% in 0.5% increments (e.g., 5.0%, 5.5%, 6.0%, etc.). The total percentage of arabinofuranosidase(s) present in the composition may include arabinofuranosidase(s) with specificity towards single substituted xylose residues, arabinofuranosidase(s) with specificity towards double substituted xylose residues, or any combination thereof. Arabinofuranosidase(s), either alone or as part of a multi-enzyme complex, may be used in amounts of 0.001 to 2.0 g/kg, 0.005 to 1.0 g/kg, or 0.05 to 0.2 g/kg of substrate.

One or more components of a multi-enzyme composition (other than proteins of the present invention) can be obtained from or derived from a microbial, plant, or other source or combination thereof, and will contain enzymes capable of degrading lignocellulosic material. Examples of enzymes included in the multi-enzyme compositions of the invention include cellulases, hemicellulases (such as xylanases, including endoxylanases, exoxylanases, and β-xylosidases; mannanases, including endomannanases, exomannanases, and β-mannosidases), ligninases, amylases, glucuronidases, proteases, esterases (including ferulic acid esterase), lipases, glucosidases (such as β-glucosidase), and xyloglucanases.

While the multi-enzyme composition may contain many types of enzymes, mixtures comprising enzymes that increase or enhance sugar release from biomass are preferred, including hemicellulases. In one embodiment, the hemicellulase is selected from a xylanase, an arabinofuranosidase, an acetyl xylan esterase, a glucuronidase, an endo-galactanase, a mannanase, an endo-arabinase, an exo-arabinase, an exo-galactanase, a ferulic acid esterase, a galactomannanase, a xylogluconase, or mixtures of any of these. In particular, the enzymes can include glucoamylase, β-xylosidase and/or β-glucosidase. Also preferred are mixtures comprising enzymes that are capable of degrading cell walls and releasing cellular contents.

The enzymes of the multi-enzyme composition can be provided by a variety of sources. In one embodiment, the enzymes can be produced by growing organisms such as bacteria, algae, fungi, and plants which produce the enzymes naturally or by virtue of being genetically modified to express the enzyme or enzymes. In another embodiment, at least one enzyme of the multi-enzyme composition is a commercially available enzyme.

In some embodiments, the multi-enzyme compositions comprise an accessory enzyme. An accessory enzyme is any additional enzyme capable of hydrolyzing lignocellulose or enhancing or promoting the hydrolysis of lignocellulose, wherein the accessory enzyme is typically provided in addition to a core enzyme or core set of enzymes. An accessory enzyme can have the same or similar function or a different function as an enzyme or enzymes in the core set of enzymes. These enzymes have been described elsewhere herein, and can generally include cellulases, xylanases, ligninases, amylases, lipidases, or glucuronidases, for example. Accessory enzymes can include enzymes that when contacted with biomass in a reaction, allow for an increase in the activity of enzymes (e.g., hemicellulases) in the multi-enzyme composition. An accessory enzyme or enzyme mix may be composed of enzymes from (1) commercial suppliers; (2) cloned genes expressing enzymes; (3) complex broth (such as that resulting from growth of a microbial strain in media, wherein the strains secrete proteins and enzymes into the media); (4) cell lysates of strains grown as in (3); and, (5) plant material expressing enzymes capable of degrading lignocellulose. In some embodiments, the accessory enzyme is a glucoamylase, a pectinase, or a ligninase.

As used herein, a ligninase is an enzyme that can hydrolyze or break down the structure of lignin polymers, including lignin peroxidases, manganese peroxidases, laccases, and other enzymes described in the art known to depolymerize or otherwise break lignin polymers. Also included are enzymes capable of hydrolyzing bonds formed between hemicellulosic sugars (notably arabinose) and lignin.

The multi-enzyme compositions, in some embodiments, comprise a biomass comprising microorganisms or a crude fermentation product of microorganisms. A crude fermentation product refers to the fermentation broth which has been separated from the microorganism biomass (by filtration, for example). In general, the microorganisms are grown in fermentors, optionally centrifuged or filtered to remove biomass, and optionally concentrated, formulated, and dried to produce an enzyme(s) or a multi-enzyme composition that is a crude fermentation product. In other embodiments, enzyme(s) or multi-enzyme compositions produced by the microorganism (including a genetically modified microorganism as described below) are subjected to one or more purification steps, such as ammonium sulfate precipitation, chromatography, and/or ultrafiltration, which result in a partially purified or purified enzyme(s). If the microorganism has been genetically modified to express the enzyme(s), the enzyme(s) will include recombinant enzymes. If the genetically modified microorganism also naturally expresses the enzyme(s) or other enzymes useful for lignocellulosic saccharification, the enzyme(s) may include both naturally occurring and recombinant enzymes.

Another embodiment of the present invention relates to a composition comprising at least about 500 ng, and preferably at least about 1 µg, and more preferably at least about 5 µg, and more preferably at least about 10 µg, and more preferably at least about 25 µg, and more preferably at least about 50 µg, and more preferably at least about 75 µg, and more preferably at least about 100 µg, and more preferably at least about 250 µg, and more preferably at least about 500 µg, and more preferably at least about 750 µg, and more preferably at least about 1 mg, and more preferably at least about 5 mg, of an isolated protein comprising any of the proteins or homologues or fragments thereof discussed herein. Such a composition of the present invention may include any carrier with which the protein is associated by virtue of the protein preparation method, a protein purification method, or a preparation of the protein for use in any method according to the present invention. For example, such a carrier can include any suitable buffer, extract, or medium that is suitable for combining with the protein of the present invention so that the protein can be used in any method described herein according to the present invention.

In one embodiment of the invention, one or more enzymes of the invention is bound to a solid support, i.e., an immobilized enzyme. As used herein, an immobilized enzyme includes immobilized isolated enzymes, immobilized microbial cells which contain one or more enzymes of the invention, other stabilized intact cells that produce one or more enzymes of the invention, and stabilized cell/membrane homogenates. Stabilized intact cells and stabilized cell/membrane homogenates include cells and homogenates from naturally occurring microorganisms expressing the enzymes of the invention and preferably, from genetically modified microorganisms as disclosed elsewhere herein. Thus, although methods for immobilizing enzymes are discussed below, it will be appreciated that such methods are equally applicable to immobilizing microbial cells and in such an embodiment, the cells can be lysed, if desired.

A variety of methods for immobilizing an enzyme are disclosed in Industrial Enzymology 2nd Ed., Godfrey, T. and West, S. Eds., Stockton Press, New York, N.Y., 1996, pp. 267-272; Immobilized Enzymes, Chibata, I. Ed., Halsted Press, New York, N.Y., 1978; Enzymes and Immobilized Cells in Biotechnology, Laskin, A. Ed., Benjamin/Cummings Publishing Co., Inc., Menlo Park, Calif., 1985; and Applied Biochemistry and Bioengineering, Vol. 4, Chibata, I. and Wingard, Jr., L. Eds, Academic Press, New York, N.Y., 1983, which are incorporated herein in their entirety.

Briefly, a solid support refers to any solid organic, biopolymer or inorganic supports that can form a bond with an enzyme without significantly effecting the activity of the enzyme. Exemplary organic solid supports include polymers such as polystyrene, nylon, phenol-formaldehyde resins, acrylic copolymers (e.g., polyacrylamide), stabilized intact whole cells, and stabilized crude whole cell/membrane homogenates. Exemplary biopolymer supports include cellulose, polydextrans (e.g., Sephadex®), agarose, collagen and chitin. Exemplary inorganic supports include glass beads (porous and nonporous), stainless steel, metal oxides (e.g., porous ceramics such as $ZrO_2$, $TiO_2$, $Al_2O_3$, and $NiO$) and sand. In one embodiment, the solid support is selected from the group consisting of stabilized intact cells and/or crude cell homogenates (e.g., produced from the microbial host cells expressing recombinant enzymes, alone or in combination with natural enzymes). Preparation of such supports requires a minimum of handling and cost. Additionally, such supports provide excellent stability of the enzyme.

Stabilized intact cells and/or cell/membrane homogenates can be produced, for example, by using bifunctional crosslinkers (e.g., glutaraldehyde) to stabilize cells and cell homogenates. In both the intact cells and the cell membranes, the cell wall and membranes act as immobilizing supports. In such a system, integral membrane proteins are in the "best" lipid membrane environment. Whether starting with intact cells or homogenates, in this system the cells are either no longer "alive" or "metabolizing", or alternatively, are "resting" (i.e., the cells maintain metabolic potential and active enzyme, but under the culture conditions are not growing); in either case, the immobilized cells or membranes serve as biocatalysts.

An enzyme of the invention can be bound to a solid support by a variety of methods including adsorption, cross-linking (including covalent bonding), and entrapment. Adsorption can be through van del Waal's forces, hydrogen bonding, ionic bonding, or hydrophobic binding. Exemplary solid supports for adsorption immobilization include polymeric adsorbents and ion-exchange resins. Solid supports in a bead form are particularly well-suited. The particle size of an adsorption solid support can be selected such that the immobilized enzyme is retained in the reactor by a mesh filter while the substrate is allowed to flow through the reactor at a desired rate. With porous particulate supports it is possible to control the adsorption process to allow enzymes or cells to be embedded within the cavity of the particle, thus providing protection without an unacceptable loss of activity.

Cross-linking of an enzyme to a solid support involves forming a chemical bond between a solid support and the enzyme. It will be appreciated that although cross-linking generally involves linking the enzyme to a solid support using an intermediary compound, it is also possible to achieve a covalent bonding between the enzyme and the solid support directly without the use of an intermediary compound. Cross-linking commonly uses a bifunctional or multifunctional reagent to activate and attach a carboxyl group, amino group, sulfur group, hydroxy group or other functional group of the enzyme to the solid support. The term "activate" refers to a chemical transformation of a functional group which allows a formation of a bond at the functional group. Exemplary amino group activating reagents include water-soluble carbodiimides, glutaraldehyde, cyanogen bromide, N-hydroxysuccinimide esters, triazines, cyanuric chloride, and carbonyl diimidazole. Exemplary carboxyl group activating reagents include water-soluble carbodiimides, and N-ethyl-5-phenyl-isoxazolium-3-sulfonate. Exemplary tyrosyl group activating reagents include diazonium compounds. And exemplary sulfhydryl group activating reagents include dithiobis-5,5'-(2-nitrobenzoic acid), and glutathione-2-pyridyl disulfide. Systems for covalently linking an enzyme directly to a solid support include Eupergit®, a polymethacrylate bead support available from Rohm Pharma (Darmstadt, Germany), kieselguhl (Macro sorbs), available from Sterling Organics, kaolinite available from English China Clay as "Biofix" supports, silica gels which can be activated by silanization, available from W.R. Grace, and high-density alumina, available from UOP (Des Plains, Ill.).

Entrapment can also be used to immobilize an enzyme. Entrapment of an enzyme involves formation of, inter alia, gels (using organic or biological polymers), vesicles (including microencapsulation), semipermeable membranes or other matrices. Exemplary materials used for entrapment of an enzyme include collagen, gelatin, agar, cellulose triacetate, alginate, polyacrylamide, polystyrene, polyurethane, epoxy resins, carrageenan, and egg albumin. Some of the polymers, in particular cellulose triacetate, can be used to entrap the enzyme as they are spun into a fiber. Other materials such as polyacrylamide gels can be polymerized in solution to entrap the enzyme. Still other materials such as polyglycol oligomers that are functionalized with polymerizable vinyl end groups can entrap enzymes by forming a cross-linked polymer with UV light illumination in the presence of a photosensitizer.

Further embodiments of the present invention include nucleic acid molecules that encode a protein of the present invention, as well as homologues or fragments of such nucleic acid molecules. A nucleic acid molecule of the present invention includes a nucleic acid molecule comprising, consisting essentially of, or consisting of, a nucleic acid sequence encoding any of the isolated proteins disclosed herein, including a fragment or a homologue of such proteins, described above. Nucleic acid molecules can include a nucleic acid sequence that encodes a fragment of a protein that does not have biological activity, and can also include portions of a gene or polynucleotide encoding the protein that are not part of the coding region for the protein (e.g., introns or regulatory regions of a gene encoding the protein). Nucleic acid molecules can include a nucleic acid sequence that is useful as a probe or primer (oligonucleotide sequences).

In one embodiment, a nucleic molecule of the present invention includes a nucleic acid molecule comprising, consisting essentially of, or consisting of, a nucleic acid sequence represented by SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:49, SEQ ID NO:51, SEQ ID NO:52, SEQ ID NO:54, SEQ ID NO:55, SEQ ID NO:57, SEQ ID NO:58, SEQ ID NO:60, SEQ ID NO:61, SEQ ID NO:63, SEQ ID NO:64, SEQ ID NO:66, SEQ ID NO:67, SEQ ID NO:69, SEQ ID NO:70, SEQ ID NO:72, SEQ ID NO:73, SEQ ID NO:75, SEQ ID NO:76, SEQ ID NO:78, SEQ ID NO:79, SEQ ID NO:81, SEQ ID NO:82, SEQ ID NO:84, SEQ ID NO:85, SEQ ID NO:87, SEQ ID NO:88, SEQ ID NO:90, SEQ ID NO:91, SEQ ID NO:93, SEQ ID NO:94, SEQ ID NO:96, SEQ ID NO:97, SEQ ID NO:99, SEQ ID NO:100, SEQ ID NO:102, SEQ ID NO:103, SEQ ID NO:105, SEQ ID NO:106, SEQ ID NO:108, SEQ ID NO:109, SEQ ID NO:111, SEQ ID NO:112, SEQ ID NO:114, SEQ ID NO:115, SEQ ID NO:117, SEQ ID NO:120, SEQ ID NO:121, SEQ ID NO:123, SEQ ID NO:124, SEQ ID NO:126, SEQ ID NO:127, SEQ ID NO:129, SEQ ID NO:130, SEQ ID NO:132, SEQ ID NO:133, SEQ ID NO:135, SEQ ID NO:136, SEQ ID NO:138, SEQ ID NO:139, SEQ ID NO:141, SEQ ID NO:142, SEQ ID NO:144, SEQ ID NO:145, SEQ ID NO:147, SEQ ID NO:148, SEQ ID NO:150, SEQ ID NO:151, SEQ ID NO:153, SEQ ID NO:154, SEQ ID NO:156, SEQ ID NO:157, SEQ ID NO:159, SEQ ID NO:160, SEQ ID NO:162, SEQ ID NO:163, SEQ ID NO:165, SEQ ID NO:166, SEQ ID NO:168, SEQ ID NO:169, SEQ ID NO:171, SEQ ID NO:172, SEQ ID NO:174, SEQ ID NO:175, SEQ ID NO:177, SEQ ID NO:178, SEQ ID NO:180, SEQ ID NO:181, SEQ ID NO:183, SEQ ID NO:184, SEQ ID NO:186, SEQ ID NO:187, SEQ ID NO:189, SEQ ID NO:190, SEQ ID NO:192, SEQ ID NO:193, SEQ ID NO:195, SEQ ID NO:196, SEQ ID NO:198, SEQ ID NO:199, SEQ ID NO:201, SEQ ID NO:202, SEQ ID NO:204, SEQ ID NO:205, SEQ ID NO:207, SEQ ID NO:208, SEQ ID NO:210, SEQ ID NO:211, SEQ ID NO:213, SEQ ID NO:214, SEQ ID NO:216, SEQ ID NO:217, SEQ ID NO:219, SEQ ID NO:220, SEQ ID NO:222, SEQ ID NO:223, SEQ ID NO:225, SEQ ID NO:226, SEQ ID NO:228, SEQ ID NO:229, SEQ ID NO:231, SEQ ID NO:232, or SEQ ID NO:234 or fragments or homologues thereof. Preferably, the nucleic acid sequence encodes a protein (including fragments and homologues thereof) useful in the invention, or encompasses useful oligonucleotides or complementary nucleic acid sequences.

In one embodiment, a nucleic molecule of the present invention includes a nucleic acid molecule comprising, consisting essentially of, or consisting of, a nucleic acid sequence encoding an amino acid sequence represented by SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO: 110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233 or fragments or homologues thereof. Preferably, the nucleic acid sequence encodes a protein (including fragments and homologues thereof) useful in the invention, or encompasses useful oligonucleotides or complementary nucleic acid sequences.

In one embodiment, such nucleic acid molecules include isolated nucleic acid molecules that hybridize under moderate stringency conditions, and more preferably under high stringency conditions, and even more preferably under very high stringency conditions, as described above, with the complement of a nucleic acid sequence encoding a protein of the present invention (i.e., including naturally occurring allelic variants encoding a protein of the present invention). Preferably, an isolated nucleic acid molecule encoding a protein of the present invention comprises a nucleic acid sequence that hybridizes under moderate, high, or very high stringency conditions to the complement of a nucleic acid sequence that encodes a protein comprising an amino acid sequence represented by SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, or SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233.

In accordance with the present invention, an isolated nucleic acid molecule is a nucleic acid molecule (polynucleotide) that has been removed from its natural milieu (i.e., that has been subject to human manipulation) and can include DNA, RNA, or derivatives of either DNA or RNA, including cDNA. As such, "isolated" does not reflect the extent to which the nucleic acid molecule has been purified. Although the phrase "nucleic acid molecule" primarily refers to the physical nucleic acid molecule, and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a protein. An isolated nucleic acid molecule of the present invention can be isolated from its natural source or produced using recombinant DNA technology (e.g., polymerase chain reaction (PCR) amplification, cloning) or chemical synthesis. Isolated nucleic acid molecules can include, for example, genes, natural allelic variants of genes, coding regions or portions thereof, and coding and/or regulatory regions modified by nucleotide insertions, deletions, substitutions, and/or inversions in a manner such that the modifications do not substantially interfere with the nucleic acid molecule's ability to encode a protein of the present invention or to form stable hybrids under stringent conditions with natural gene isolates. An isolated nucleic acid molecule can include degeneracies. As used herein, nucleotide degeneracy refers to the phenomenon that one amino acid can be encoded by different nucleotide codons. Thus, the nucleic acid sequence of a nucleic acid molecule that encodes a protein of the present invention can vary due to degeneracies. It is noted that a nucleic acid molecule of the present invention is not required to encode a protein having protein activity. A nucleic acid molecule can encode a truncated, mutated or inactive protein, for example. In addition, nucleic acid molecules of the invention are useful as probes and primers for the identification, isolation and/or purification of other nucleic acid molecules. If the nucleic acid molecule is an oligonucleotide, such as a probe or primer, the oligonucleotide preferably ranges from about 5 to about 50 or about 500 nucleotides, more preferably from about 10 to about 40 nucleotides, and most preferably from about 15 to about 40 nucleotides in length.

According to the present invention, reference to a gene includes all nucleic acid sequences related to a natural (i.e. wild-type) gene, such as regulatory regions that control production of the protein encoded by that gene (such as, but not limited to, transcription, translation or post-translation control regions) as well as the coding region itself. In another embodiment, a gene can be a naturally occurring allelic variant that includes a similar but not identical sequence to the nucleic acid sequence encoding a given protein. Allelic variants have been previously described above. The phrases "nucleic acid molecule" and "gene" can be used interchangeably when the nucleic acid molecule comprises a gene as described above.

Preferably, an isolated nucleic acid molecule of the present invention is produced using recombinant DNA technology (e.g., polymerase chain reaction (PCR) amplification, cloning, etc.) or chemical synthesis. Isolated nucleic acid molecules include any nucleic acid molecules and homologues thereof that are part of a gene described herein and/or that encode a protein described herein, including, but not limited to, natural allelic variants and modified nucleic acid molecules (homologues) in which nucleotides have been inserted, deleted, substituted, and/or inverted in such a manner that such modifications provide the desired effect on protein biological activity or on the activity of the nucleic acid molecule. Allelic variants and protein homologues (e.g., proteins encoded by nucleic acid homologues) have been discussed in detail above.

A nucleic acid molecule homologue (i.e., encoding a homologue of a protein of the present invention) can be produced using a number of methods known to those skilled in the art (see, for example, Sambrook et al.). For example, nucleic acid molecules can be modified using a variety of techniques including, but not limited to, by classic mutagenesis and recombinant DNA techniques (e.g., site-directed mutagenesis, chemical treatment, restriction enzyme cleavage, ligation of nucleic acid fragments and/or PCR amplification), or synthesis of oligonucleotide mixtures and ligation of mixture groups to "build" a mixture of nucleic acid molecules and combinations thereof. Another method for modifying a recombinant nucleic acid molecule encoding a protein is gene shuffling (i.e., molecular breeding) (See, for example, U.S. Pat. No. 5,605,793 to Stemmer; Minshull and Stemmer; 1999, *Curr. Opin. Chem. Biol.* 3:284-290; Stemmer, 1994, *P.N.A.S. USA* 91:10747-10751, all of which are incorporated herein by reference in their entirety). This technique can be used to efficiently introduce multiple simultaneous changes in the protein. Nucleic acid molecule homologues can be selected by hybridization with a gene or polynucleotide, or by screening for the function of a protein encoded by a nucleic acid molecule (i.e., biological activity).

The minimum size of a nucleic acid molecule of the present invention is a size sufficient to encode a protein (including a fragment or homologue of a full-length protein) having biological activity, sufficient to encode a protein comprising at least one epitope which binds to an antibody, or sufficient to form a probe or oligonucleotide primer that is capable of forming a stable hybrid with the complementary sequence of a nucleic acid molecule encoding a natural protein (e.g., under moderate, high, or high stringency conditions). As such, the size of the nucleic acid molecule encoding such a protein can be dependent on nucleic acid composition and percent homology or identity between the nucleic acid molecule and complementary sequence as well as upon hybridization conditions per se (e.g., temperature, salt concentration, and formamide concentration). The minimal size of a nucleic acid molecule that is used as an oligonucleotide primer or as a probe is typically at least about 12 to about 15 nucleotides in length if the nucleic acid molecules are GC-rich and at least about 15 to about 18 bases in length if they are AT-rich. There is no limit, other than a practical limit, on the maximal size of a nucleic acid molecule of the present invention, in that the nucleic acid molecule can include a portion of a protein encoding sequence, a nucleic acid sequence encoding a full-length protein (including a gene), including any length fragment between about 20 nucleotides and the number of nucleotides that make up the full length cDNA encoding a protein, in whole integers (e.g., 20, 21, 22, 23, 24, 25 . . . nucleotides), or multiple genes, or portions thereof.

The phrase "consisting essentially of", when used with reference to a nucleic acid sequence herein, refers to a nucleic acid sequence encoding a specified amino acid sequence that can be flanked by from at least one, and up to as many as about 60, additional heterologous nucleotides at each of the 5' and/or the 3' end of the nucleic acid sequence encoding the specified amino acid sequence. The heterologous nucleotides are not naturally found (i.e., not found in nature, in vivo) flanking the nucleic acid sequence encoding the specified amino acid sequence as it occurs in the natural gene or do not encode a protein that imparts any additional function to the protein or changes the function of the protein having the specified amino acid sequence.

In one embodiment, the polynucleotide probes or primers of the invention are conjugated to detectable markers. Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), enzymes (e.g., horse radish peroxidase, alkaline phos-phatase and others commonly used in an ELISA), and colorimetric labels such as colloidal gold or colored glass or plastic (e.g., polystyrene, polypropylene, latex, etc.) beads. Preferably, the polynucleotide probes are immobilized on a substrate such as: artificial membranes, organic supports, biopolymer supports and inorganic supports.

One embodiment of the present invention relates to a recombinant nucleic acid molecule which comprises the isolated nucleic acid molecule described above which is operatively linked to at least one expression control sequence. More particularly, according to the present invention, a recombinant nucleic acid molecule typically comprises a recombinant vector and any one or more of the isolated nucleic acid molecules as described herein. According to the present invention, a recombinant vector is an engineered (i.e., artificially produced) nucleic acid molecule that is used as a tool for manipulating a nucleic acid sequence of choice and/or for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. Such a vector typically contains heterologous nucleic acid sequences, that is, nucleic acid sequences that are not naturally found adjacent to nucleic acid sequence to be cloned or delivered, although the vector can also contain regulatory nucleic acid sequences (e.g., promoters, untranslated regions) which are naturally found adjacent to nucleic acid sequences of the present invention or which are useful for expression of the nucleic acid molecules of the present invention (discussed in detail below). The vector can be either RNA or DNA, either prokaryotic or eukaryotic, and typically is a plasmid. The vector can be maintained as an extrachromosomal element (e.g., a plasmid) or it can be integrated into the chromosome of a recombinant host cell, although it is preferred if the vector remain separate from the genome for most applications of the invention. The entire vector can remain in place within a host cell, or under certain conditions, the plasmid DNA can be deleted, leaving behind the nucleic acid molecule of the present invention. An integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain at least one selectable marker.

In one embodiment, a recombinant vector used in a recombinant nucleic acid molecule of the present invention is an expression vector. As used herein, the phrase "expression vector" is used to refer to a vector that is suitable for production of an encoded product (e.g., a protein of interest, such as an enzyme of the present invention). In this embodiment, a nucleic acid sequence encoding the product to be produced (e.g., the protein or homologue thereof) is inserted into the recombinant vector to produce a recombinant nucleic acid molecule. The nucleic acid sequence encoding the protein to be produced is inserted into the vector in a manner that operatively links the nucleic acid sequence to regulatory sequences in the vector which enable the transcription and translation of the nucleic acid sequence within the recombinant host cell.

Typically, a recombinant nucleic acid molecule includes at least one nucleic acid molecule of the present invention operatively linked to one or more expression control sequences (e.g., transcription control sequences or translation control sequences). As used herein, the phrase "recombinant molecule" or "recombinant nucleic acid molecule" primarily refers to a nucleic acid molecule or nucleic acid sequence operatively linked to a transcription control sequence, but can be used interchangeably with the phrase "nucleic acid molecule", when such nucleic acid molecule is a recombinant molecule as discussed herein. According to the present invention, the phrase "operatively linked" refers to linking a nucleic acid molecule to an expression control sequence in a manner such that the molecule is able to be expressed when transfected (i.e., transformed, transduced, transfected, conjugated or conduced) into a host cell. Transcription control sequences are sequences which control the initiation, elongation, or termination of transcription. Particularly important transcription control sequences are those which control transcription initiation, such as promoter, enhancer, operator and repressor sequences. Suitable transcription control sequences include any transcription control sequence that can function in a host cell or organism into which the recombinant nucleic acid molecule is to be introduced.

Recombinant nucleic acid molecules of the present invention can also contain additional regulatory sequences, such as translation regulatory sequences, origins of replication, and other regulatory sequences that are compatible with the recombinant cell. In one embodiment, a recombinant molecule of the present invention, including those which are integrated into the host cell chromosome, also contains secretory signals (i.e., signal segment nucleic acid sequences) to enable an expressed protein to be secreted from the cell that produces the protein. Suitable signal segments include a signal segment that is naturally associated with the protein to be expressed or any heterologous signal segment capable of directing the secretion of the protein according to the present invention. In another embodiment, a recombinant molecule of the present invention comprises a leader sequence to enable an expressed protein to be delivered to and inserted into the membrane of a host cell. Suitable leader sequences include a leader sequence that is naturally associated with the protein, or any heterologous leader sequence capable of directing the delivery and insertion of the protein to the membrane of a cell.

According to the present invention, the term "transfection" is generally used to refer to any method by which an exogenous nucleic acid molecule (i.e., a recombinant nucleic acid molecule) can be inserted into a cell. The term "transformation" can be used interchangeably with the term "transfection" when such term is used to refer to the introduction of nucleic acid molecules into microbial cells or plants and describes an inherited change due to the acquisition of exogenous nucleic acids by the microorganism that is essentially synonymous with the term "transfection." Transfection techniques include, but are not limited to, transformation, particle bombardment, electroporation, microinjection, lipofection, adsorption, infection and protoplast fusion.

One or more recombinant molecules of the present invention can be used to produce an encoded product (e.g., a protein) of the present invention. In one embodiment, an encoded product is produced by expressing a nucleic acid molecule as described herein under conditions effective to produce the protein. A preferred method to produce an encoded protein is by transfecting a host cell with one or more recombinant molecules to form a recombinant cell. Suitable host cells to transfect include, but are not limited to, any bacterial, fungal (e.g., filamentous fungi or yeast or mushrooms), algal, plant, insect, or animal cell that can be transfected. Host cells can be either untransfected cells or cells that are already transfected with at least one other recombinant nucleic acid molecule.

Suitable cells (e.g., a host cell or production organism) may include any microorganism (e.g., a bacterium, a protist, an alga, a fungus, or other microbe), and is preferably a bacterium, a yeast or a filamentous fungus. Suitable bacterial genera include, but are not limited to, *Escherichia, Bacillus, Lactobacillus, Pseudomonas* and *Streptomyces*. Suitable bacterial species include, but are not limited to, *Escherichia coli, Bacillus subtilis, Bacillus licheniformis, Lactobacillus brevis, Pseudomonas aeruginosa* and *Streptomyces lividans*. Suitable genera of yeast include, but are not limited to, *Saccharomyces, Schizosaccharomyces, Candida, Hansenula, Pichia, Kluyveromyces*, and *Phaffia*. Suitable yeast species include, but are not limited to, *Saccharomyces cerevisiae, Schizosaccharomyces pombe, Candida albicans, Hansenula polymorpha, Pichia pastoris, P. canadensis, Kluyveromyces marxianus* and *Phaffia rhodozyma*.

Suitable fungal genera include, but are not limited to, *Chrysosporium, Thielavia, Neurospora, Aureobasidium, Filibasidium, Piromyces, Corynascus, Cryplococcus, Acremonium, Tolypocladium, Scytalidium, Schizophyllum, Sporotrichum, Penicillium, Gibberella, Myceliophthora, Mucor, Aspergillus, Fusarium, Humicola*, and *Trichoderma*, and anamorphs and teleomorphs thereof. Suitable fungal species include, but are not limited to, *Aspergillus niger, Aspergillus nidulans, Aspergillus japonicus, Absidia coerulea, Rhizopus oryzae, Chrysosporium lucknowense, Neurospora crassa, Neurospora intermedia, Trichoderma reesei, Penicillium canescens, Penicillium solitum, Penicillium funiculosum*, and *Talaromyces flavus*. In one embodiment, the host cell is a fungal cell of the species *Chrysosporium lucknowense*. In one embodiment, the host cell is a fungal cell of Strain C1 (VKM F-3500-D) or a mutant strain derived therefrom (e.g., UV13-6 (Accession No. VKM F-3632 D); NG7C-19 (Accession No. VKM F-3633 D); or UV18-25 (VKM F-3631D)). Host cells can be either untransfected cells or cells that are already transfected with at least one other recombinant nucleic acid molecule. Additional embodiments of the present invention include any of the genetically modified cells described herein.

In one embodiment, one or more protein(s) expressed by an isolated nucleic acid molecule of the present invention are produced by culturing a cell that expresses the protein (i.e., a recombinant cell or recombinant host cell) under conditions effective to produce the protein. In some instances, the protein may be recovered, and in others, the cell may be harvested in whole, either of which can be used in a composition.

Microorganisms used in the present invention (including recombinant host cells or genetically modified microorganisms) are cultured in an appropriate fermentation medium. An appropriate, or effective, fermentation medium refers to any medium in which a cell of the present invention, including a genetically modified microorganism (described below), when cultured, is capable of expressing enzymes useful in the present invention and/or of catalyzing the production of sugars from lignocellulosic biomass. Such a medium is typically an aqueous medium comprising assimilable carbon, nitrogen and phosphate sources. Such a medium can also include appropriate salts, minerals, metals and other nutrients. Microorganisms and other cells of the present invention can be cultured in conventional fermentation bioreactors. The microorganisms can be cultured by any fermentation process which includes, but is not limited to, batch, fed-batch, cell recycle, and continuous fermentation. The fermentation of microorganisms such as fungi may be carried out in any appropriate reactor, using methods known to those skilled in the art. For example, the fermentation may be carried out for a period of 1 to 14 days, or more preferably between about 3 and 10 days. The temperature of the medium is typically maintained between about 25 and 50° C., and more preferably between 28 and 40° C. The pH of the fermentation medium is regulated to a pH suitable for growth and protein production of the particular organism. The fermentor can be aerated in order to supply the oxygen necessary for fermentation and to avoid the excessive accumulation of carbon dioxide produced by fermentation. In addition, the aeration helps to control the temperature and the moisture of the culture medium. In general the fungal strains are grown in fermentors, optionally centrifuged or filtered to remove biomass, and optionally concentrated, formulated, and dried to produce an enzyme(s) or a multi-enzyme composition that is a crude fermentation product. Particularly suitable conditions for culturing filamentous fungi are described, for example, in U.S. Pat. No. 6,015,707 and U.S. Pat. No. 6,573,086, supra.

Depending on the vector and host system used for production, resultant proteins of the present invention may either remain within the recombinant cell; be secreted into the culture medium; be secreted into a space between two cellular membranes; or be retained on the outer surface of a cell membrane. The phrase "recovering the protein" refers to collecting the whole culture medium containing the protein and need not imply additional steps of separation or purification. Proteins produced according to the present invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

Proteins of the present invention are preferably retrieved, obtained, and/or used in "substantially pure" form. As used herein, "substantially pure" refers to a purity that allows for the effective use of the protein in any method according to the present invention. For a protein to be useful in any of the methods described herein or in any method utilizing enzymes of the types described herein according to the present invention, it is substantially free of contaminants, other proteins and/or chemicals that might interfere or that would interfere with its use in a method disclosed by the present invention (e.g., that might interfere with enzyme activity), or that at least would be undesirable for inclusion with a protein of the present invention (including homologues) when it is used in a method disclosed by the present invention (described in detail below). Preferably, a "substantially pure" protein, as referenced herein, is a protein that can be produced by any method (i.e., by direct purification from a natural source, recombinantly, or synthetically), and that has been purified from other protein components such that the protein comprises at least about 80% weight/weight of the total protein in a given composition (e.g., the protein of interest is about 80% of the protein in a solution/composition/buffer), and more preferably, at least about 85%, and more preferably at least about 90%, and more preferably at least about 91%, and more preferably at least about 92%, and more preferably at least about 93%, and more preferably at least about 94%, and more preferably at least about 95%, and more preferably at least about 96%, and more preferably at least about 97%, and more preferably at least about 98%, and more preferably at least about 99%, weight/weight of the total protein in a given composition.

It will be appreciated by one skilled in the art that use of recombinant DNA technologies can improve control of expression of transfected nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites), modification of nucleic acid molecules to correspond to the codon usage of the host cell, and deletion of sequences that destabilize transcripts.

Another aspect of the present invention relates to a genetically modified microorganism that has been transfected with one or more nucleic acid molecules of the present invention. As used herein, a genetically modified microorganism can include a genetically modified bacterium, alga, yeast, filamentous fungus, or other microbe. Such a genetically modified microorganism has a genome which is modified (i.e., mutated or changed) from its normal (i.e., wild-type or naturally occurring) form such that the desired result is achieved (i.e., increased or modified activity and/or production of at least one enzyme or a multi-enzyme composition for the conversion of lignocellulosic material to fermentable sugars). Genetic modification of a microorganism can be accomplished using classical strain development and/or molecular genetic techniques. Such techniques known in the art and are generally disclosed for microorganisms, for example, in Sambrook et al., 1989, *Molecular Cloning: A Laboratory Manual*, Cold Spring Harbor Labs Press or *Molecular Cloning: A Laboratory Manual*, third edition (Sambrook and Russel, 2001), jointly referred to herein as "Sambrook"). The references of Sambrook, ibid., are incorporated by reference herein in its entirety. A genetically modified microorganism can include a microorganism in which nucleic acid molecules have been inserted, deleted or modified (i.e., mutated; e.g., by insertion, deletion, substitution, and/or inversion of nucleotides), in such a manner that such modifications provide the desired effect within the microorganism.

In one embodiment, a genetically modified microorganism can endogenously contain and express an enzyme or a multi-enzyme composition for the conversion of lignocellulosic material to fermentable sugars, and the genetic modification can be a genetic modification of one or more of such endogenous enzymes, whereby the modification has some effect on the ability of the microorganism to convert lignocellulosic material to fermentable sugars (e.g., increased expression of the protein by introduction of promoters or other expression control sequences, or modification of the coding region by homologous recombination to increase the activity of the encoded protein).

In another embodiment, a genetically modified microorganism can endogenously contain and express an enzyme for the conversion of lignocellulosic material to fermentable sugars, and the genetic modification can be an introduction of at least one exogenous nucleic acid sequence (e.g., a recombinant nucleic acid molecule), wherein the exogenous nucleic acid sequence encodes at least one additional enzyme useful for the conversion of lignocellulosic material to fermentable sugars and/or a protein that improves the efficiency of the enzyme for the conversion of lignocellulosic material to fermentable sugars. In this aspect of the invention, the microorganism can also have at least one modification to a gene or genes comprising its endogenous enzyme(s) for the conversion of lignocellulosic material to fermentable sugars.

In yet another embodiment, the genetically modified microorganism does not necessarily endogenously (naturally) contain an enzyme for the conversion of lignocellulosic material to fermentable sugars, but is genetically modified to introduce at least one recombinant nucleic acid molecule encoding at least one enzyme or a multiplicity of enzymes for the conversion of lignocellulosic material to fermentable sugars. Such a microorganism can be used in a method of the invention, or as a production microorganism for crude fermentation products, partially purified recombinant enzymes, and/or purified recombinant enzymes, any of which can then be used in a method of the present invention.

Once the proteins (enzymes) are expressed in a host cell, a cell extract that contains the activity to test can be generated. For example, a lysate from the host cell is produced, and the supernatant containing the activity is harvested and/or the activity can be isolated from the lysate. In the case of cells that secrete enzymes into the culture medium, the culture medium containing them can be harvested, and/or the activity can be purified from the culture medium. The extracts/activities prepared in this way can be tested using assays known in the art. Accordingly, methods to identify mutli-enzyme compositions capable of degrading lignocellulosic biomass are provided.

Artificial substrates, or complex mixtures of polymeric carbohydrates and lignin, or actual lignocellulose can be used in such tests. One assay that may be used to measure the release of sugars and oligosaccharides from these complex substrates is the dinitrosalicylic acid assay (DNS). In this assay, the lignocellulosic material such as DDG is incubated with enzymes(s) for various times and reducing sugars are measured.

The present invention is not limited to microorganisms and also contemplates genetically modified organisms such as algae, fungi and plants transformed with one or more nucleic acid molecules of the invention. The plants may be used for production of the enzymes, and/or as the lignocellulosic material used as a substrate in the methods of the invention. Methods to generate recombinant plants are known in the art. For instance, numerous methods for plant transformation have been developed, including biological and physical transformation protocols. See, for example, Miki et al., "Procedures for Introducing Foreign DNA into Plants" in *Methods in Plant Molecular Biology and Biotechnology*, Glick, B. R. and Thompson, J. E. Eds. (CRC Press, Inc., Boca Raton, 1993) pp. 67-88. In addition, vectors and in vitro culture methods for plant cell or tissue transformation and regeneration of plants are available. See, for example, Gruber et al., "Vectors for Plant Transformation" in *Methods in Plant Molecular Biology and Biotechnology*, Glick, B. R. and Thompson, J. E. Eds. (CRC Press, Inc., Boca Raton, 1993) pp. 89-119.

The most widely utilized method for introducing an expression vector into plants is based on the natural transformation system of *Agrobacterium*. See, for example, Horsch et al., *Science* 227:1229 (1985). *A. tumefaciens* and *A. rhizogenes* are plant pathogenic soil bacteria which genetically transform plant cells. The Ti and Ri plasmids of *A. tumefaciens* and *A. rhizogenes*, respectively, carry genes responsible for genetic transformation of the plant. See, for example, Kado, C. I., *Crit. Rev. Plant. Sci.* 10:1 (1991). Descriptions of Agrobacterium vector systems and methods for *Agrobacterium*-mediated gene transfer are provided by numerous references, including Gruber et al., supra, Miki et al., supra, Moloney et al., *Plant Cell Reports* 8:238 (1989), and U.S. Pat. Nos. 4,940,838 and 5,464,763.

Another generally applicable method of plant transformation is microprojectile-mediated transformation wherein DNA is carried on the surface of microprojectiles. The expression vector is introduced into plant tissues with a biolistic device that accelerates the microprojectiles to speeds sufficient to penetrate plant cell walls and membranes. Sanford et al., *Part. Sci. Technol.* 5:27 (1987), Sanford, J. C., *Trends Biotech.* 6:299 (1988), Sanford, J. C., *Physiol. Plant* 79:206 (1990), Klein et al., *Biotechnology* 10:268 (1992).

Another method for physical delivery of DNA to plants is sonication of target cells. Zhang et al., *Bio/Technology* 9:996 (1991). Alternatively, liposome or spheroplast fusion have been used to introduce expression vectors into plants. Deshayes et al., *EMBO J.*, 4:2731 (1985), Christou et al., *Proc Natl. Acad. Sci. USA* 84:3962 (1987). Direct uptake of DNA into protoplasts using $CaCl_2$ precipitation, polyvinyl alcohol or poly-L-ornithine have also been reported. Hain et al., *Mol. Gen. Genet.* 199:161 (1985) and Draper et al., *Plant Cell Physiol.* 23:451 (1982). Electroporation of protoplasts and whole cells and tissues have also been described. Donn et al., In Abstracts of VIIth International Congress on Plant Cell and Tissue Culture IAPTC, A2-38, p. 53 (1990); D'Halluin et al., *Plant Cell* 4:1495-1505 (1992) and Spencer et al., *Plant Mol. Biol.* 24:51-61 (1994).

Some embodiments of the present invention include genetically modified organisms comprising at least one nucleic acid molecule encoding at least one enzyme of the present invention, in which the activity of the enzyme is downregulated. The downregulation may be achieved, for example, by introduction of inhibitors (chemical or biological) of the enzyme activity, by manipulating the efficiency with which those nucleic acid molecules are transcribed, the efficiency with which the resultant transcripts are translated, and the efficiency of post-translational modifications, or by "knocking out" the endogenous copy of the gene. A "knock out" of a gene refers to a molecular biological technique by which the gene in the organism is made inoperative, so that the expression of the gene is substantially reduced or eliminated. Alternatively, in some embodiments the activity of the enzyme may be upregulated. The present invention also contemplates downregulating activity of one or more enzymes while simultaneously upregulating activity of one or more enzymes to achieve the desired outcome.

Another embodiment of the present invention relates to an isolated binding agent capable of selectively binding to a protein of the present invention. Suitable binding agents may be selected from an antibody, an antigen binding fragment, or a binding partner. The binding agent selectively binds to an amino acid sequence selected from SEQ ID NO:2, SEQ ID NO:5, SEQ ID NO:8, SEQ ID NO:11, SEQ ID NO:14, SEQ ID NO:17, SEQ ID NO:20, SEQ ID NO:23, SEQ ID NO:26, SEQ ID NO:29, SEQ ID NO:32, SEQ ID NO:35, SEQ ID NO:38, SEQ ID NO:41, SEQ ID NO:44, SEQ ID NO:47, SEQ ID NO:50, SEQ ID NO:53, SEQ ID NO:56, SEQ ID NO:59, SEQ ID NO:62, SEQ ID NO:65, SEQ ID NO:68, SEQ ID NO:71, SEQ ID NO:74, SEQ ID NO:77, SEQ ID NO:80, SEQ ID NO:83, SEQ ID NO:86, SEQ ID NO:89, SEQ ID NO:92, SEQ ID NO:95, SEQ ID NO:98, SEQ ID NO:101, SEQ ID NO:104, SEQ ID NO:107, SEQ ID NO:110, SEQ ID NO:113, SEQ ID NO:116, SEQ ID NO:119, SEQ ID NO:122, SEQ ID NO:125, SEQ ID NO:128, SEQ ID NO:131, SEQ ID NO:134, SEQ ID NO:137, SEQ ID NO:140, SEQ ID NO:143, SEQ ID NO:146, SEQ ID NO:149, SEQ ID NO:152, SEQ ID NO:155, SEQ ID NO:158, SEQ ID NO:161, SEQ ID NO:164, SEQ ID NO:167, SEQ ID NO:170, SEQ ID NO:173, SEQ ID NO:176, SEQ ID NO:179, SEQ ID NO:182, SEQ ID NO:185, SEQ ID NO:188, SEQ ID NO:191, SEQ ID NO:194, SEQ ID NO:197, SEQ ID NO:200, or SEQ ID NO:203, SEQ ID NO:206, SEQ ID NO:209, SEQ ID NO:212, SEQ ID NO:215, SEQ ID NO:218, SEQ ID NO:221, SEQ ID NO:224, SEQ ID NO:227, SEQ ID NO:230, or SEQ ID NO:233 including to any fragment of any of the above sequences comprising at least one antibody binding epitope.

According to the present invention, the phrase "selectively binds to" refers to the ability of an antibody, antigen binding fragment or binding partner of the present invention to preferentially bind to specified proteins. More specifically, the phrase "selectively binds" refers to the specific binding of one protein to another (e.g., an antibody, fragment thereof, or binding partner to an antigen), wherein the level of binding, as measured by any standard assay (e.g., an immunoassay), is statistically significantly higher than the background control for the assay. For example, when performing an immunoassay, controls typically include a reaction well/tube that contain antibody or antigen binding fragment alone (i.e., in the absence of antigen), wherein an amount of reactivity (e.g., non-specific binding to the well) by the antibody or antigen binding fragment thereof in the absence of the antigen is considered to be background. Binding can be measured using a variety of methods standard in the art including enzyme immunoassays (e.g., ELISA), immunoblot assays, etc.).

Antibodies are characterized in that they comprise immunoglobulin domains and as such, they are members of the immunoglobulin superfamily of proteins. An antibody of the invention includes polyclonal and monoclonal antibodies, divalent and monovalent antibodies, bi- or multi-specific antibodies, serum containing such antibodies, antibodies that have been purified to varying degrees, and any functional equivalents of whole antibodies. Isolated antibodies of the present invention can include serum containing such antibodies, or antibodies that have been purified to varying degrees. Whole antibodies of the present invention can be polyclonal or monoclonal. Alternatively, functional equivalents of whole antibodies, such as antigen binding fragments in which one or more antibody domains are truncated or absent (e.g., Fv, Fab, Fab', or F(ab)$_2$ fragments), as well as genetically-engineered antibodies or antigen binding fragments thereof, including single chain antibodies or antibodies that can bind to more than one epitope (e.g., bi-specific antibodies), or antibodies that can bind to one or more different antigens (e.g., bi- or multi-specific antibodies), may also be employed in the invention. Methods for the generation and production of antibodies are well known in the art.

Monoclonal antibodies may be produced according to the methodology of Kohler and Milstein (*Nature* 256:495-497, 1975). Non-antibody polypeptides, sometimes referred to as binding partners, are designed to bind specifically to a protein of the invention. Examples of the design of such polypeptides, which possess a prescribed ligand specificity are given in Beste et al. (*Proc. Natl. Acad. Sci.* 96:1898-1903, 1999), incorporated herein by reference in its entirety. In one embodiment, a binding agent of the invention is immobilized on a substrate such as: artificial membranes, organic supports, biopolymer supports and inorganic supports such as for use in a screening assay.

Proteins of the present invention, at least one protein of the present invention, compositions comprising such protein(s) of the present invention, and multi-enzyme compositions (examples of which are described above) may be used in any method where it is desirable to hydrolyze glycosidic linkages in lignocellulosic material, or any other method wherein enzymes of the same or similar function are useful.

In one embodiment, the present invention includes the use of at least one protein of the present invention, compositions comprising at least one protein of the present invention, or multi-enzyme compositions in methods for hydrolyzing lignocellulose and the generation of fermentable sugars therefrom. In one embodiment, the method comprises contacting the lignocellulosic material with an effective amount of one or more proteins of the present invention, composition comprising at least one protein of the present invention, or a multi-enzyme composition, whereby at least one fermentable sugar is produced (liberated). The lignocellulosic material may be partially or completely degraded to fermentable sugars. Economical levels of degradation at commercially viable costs are contemplated.

Typically, the amount of enzyme or enzyme composition contacted with the lignocellulose will depend upon the amount of glucan present in the lignocellulose. In some embodiments, the amount of enzyme or enzyme composition contacted with the lignocellulose may be from about 0.1 to about 200 mg enzyme or enzyme composition per gram of glucan; in other embodiments, from about 3 to about 20 mg enzyme or enzyme composition per gram of glucan. The invention encompasses the use of any suitable or sufficient amount of enzyme or enzyme composition between about 0.1 mg and about 200 mg enzyme per gram glucan, in increments of 0.05 mg (i.e., 0.1 mg, 0.15 mg, 0.2 mg . . . 199.9 mg, 199.95 mg, 200 mg).

In a further embodiment, the invention provides a method for degrading DDG, preferably, but not limited to, DDG derived from corn, to sugars. The method comprises contacting the DDG with a protein of the present invention, a composition comprising at least one protein of the present invention, or a multi-enzyme composition. In certain embodiments, at least 10% of fermentable sugars are liberated. In other embodiment, the at least 15% of the sugars are liberated, or at least 20% of the sugars are liberated, or at least 23% of the sugars are liberated, or at least 24% of the sugars are liberated, or at least 25% of the sugars are liberated, or at least 26% of the sugars are liberated, or at least 27% of the sugars are liberated, or at least 28% of the sugars are liberated.

In another embodiment, the invention provides a method for producing fermentable sugars comprising cultivating a genetically modified microorganism of the present invention in a nutrient medium comprising a lignocellulosic material, whereby fermentable sugars are produced.

Also provided are methods that comprise further contacting the lignocellulosic material with at least one accessory enzyme. Accessory enzymes have been described elsewhere herein. The accessory enzyme or enzymes may be added at the same time, prior to, or following the addition of a protein of the present invention, a composition comprising at least one protein of the present invention, or a multi-enzyme composition, or can be expressed (endogenously or overexpressed) in a genetically modified microorganism used in a method of the invention. When added simultaneously, the protein of the present invention, a composition comprising at least one protein of the present invention, or a multi-enzyme composition will be compatible with the accessory enzymes selected. When the enzymes are added following the treatment with the protein of the present invention, a composition comprising at least one protein of the present invention, or a multi-enzyme composition, the conditions (such as temperature and pH) may be altered to those optimal for the accessory enzyme before, during, or after addition of the accessory enzyme. Multiple rounds enzyme addition are also encompassed. The accessory enzyme may also be present in the lignocellulosic material itself as a result of genetically modifying the plant. The nutrient medium used in a fermentation can also comprise one or more accessory enzymes.

In some embodiments, the method comprises a pretreatment process. In general, a pretreatment process will result in components of the lignocellulose being more accessible for downstream applications or so that it is more digestible by enzymes following treatment in the absence of hydrolysis. The pretreatment can be a chemical, physical or biological pretreatment. The lignocellulose may have been previously treated to release some or all of the sugars, as in the case of DDG. Physical treatments, such as grinding, boiling, freezing, milling, vacuum infiltration, and the like may also be used with the methods of the invention. In one embodiment, the heat treatment comprises heating the lignocellulosic material to 121° C. for 15 minutes. A physical treatment such as milling can allow a higher concentration of lignocellulose to be used in the methods of the invention. A higher concentration refers to about 20%, up to about 25%, up to about 30%, up to about 35%, up to about 40%, up to about 45%, or up to about 50% lignocellulose. The lignocellulose may also be contacted with a metal ion, ultraviolet light, ozone, and the like. Additional pretreatment processes are known to those skilled in the art, and can include, for example, organosolv treatment, steam explosion treatment, lime impregnation with steam explosion treatment, hydrogen peroxide treatment, hydrogen peroxide/ozone (peroxone) treatment, acid treatment, dilute acid treatment, and base treatment, including ammonia fiber explosion (AFEX) technology. Details on pretreatment technologies and processes can be found in Wyman et al., *Bioresource Tech.* 96:1959 (2005); Wyman et al., *Bioresource Tech.* 96:2026 (2005); Hsu, "Pretreatment of biomass" In Handbook on Bioethanol: Production and Utilization, Wyman, Taylor and Francis Eds., p. 179-212 (1996); and Mosier et al., *Bioresource Tech.* 96:673 (2005).

In an additional embodiment, the method comprises detoxifying the lignocellulosic material. Detoxification may be desirable in the event that inhibitors are present in the lignocellulosic material. Such inhibitors can be generated by a pretreatment process, deriving from sugar degradation or are direct released from the lignocellulose polymer. Detoxifying can include the reduction of their formation by adjusting sugar extraction conditions; the use of inhibitor-tolerant or inhibitor-degrading strains of microorganisms. Detoxifying can also be accomplished by the addition of ion exchange resins, active charcoal, enzymatic detoxification using, e.g., laccase, and the like. In some embodiments, the proteins, compositions or products of the present invention further comprises detoxifying agents.

In some embodiments, the methods may be performed one or more times in whole or in part. That is, one may perform one or more pretreatments, followed by one or more reactions with a protein of the present invention, composition or product of the present invention and/or accessory enzyme. The enzymes may be added in a single dose, or may be added in a series of small doses. Further, the entire process may be repeated one or more times as necessary. Therefore, one or more additional treatments with heat and enzymes are contemplated.

The methods described above result in the production of fermentable sugars. During, or subsequent to the methods described, the fermentable sugars may be recovered. In the case of a cultivation of microorganisms, the sugars can be recovered through a continuous, batch or fed-batch method. The sugars recovered can be concentrated or purified. Recovery may occur by any method known in the art, including, but not limited to, washing, gravity flow, pressure, chromatography, extraction, crystallization (e.g., evaporative crystallization), membrane separation, reverse osmosis, distillation, and filtration. The sugars can be subjected further processing; e.g., they can also be sterilized, for example, by filtration.

In a related embodiment, the invention provides means for improving quality of lignocellulosic material, including DDG for animal nutrition. In one embodiment, the treated lignocellulosic material (e.g., a lignocellulosic material which has been saccharified) is recovered (e.g., has the soluble sugars removed). The recovered material can be used as an animal feed additive. It is believed that the recovered material will have beneficial properties for animal nutrition, possibly due to a higher protein content. In some embodiments, the amount of enzyme or enzyme composition contacted with the lignocellulosic material may be from about 0.0001% to about 1.0% of the weight of the lignocellulosic material; in other embodiments, from about 0.005% to about 0.1% of the weight of the lignocellulosic material. The invention includes the use of any amount of enzyme or enzyme composition between about 0.0001% and about 1.0%, in increments of 0.0001 (i.e., 0.0001, 0.0002, 0.0003 . . . etc.).

In an additional embodiment, the invention provides a method for producing an organic substance, comprising saccharifying a lignocellulosic material with an effective amount of a protein of the present invention or a composition comprising at least one protein of the present invention, fermenting the saccharified lignocellulosic material obtained with one or more fermentating microorganisms, and recovering the organic substance from the fermentation. Sugars released from biomass can be converted to useful fermentation products including but not limited to amino acids, vitamins, pharmaceuticals, animal feed supplements, specialty chemicals, chemical feedstocks, plastics, solvents, fuels, or other organic polymers, lactic acid, and ethanol, including fuel ethanol. Specific products that may be produced by the methods of the invention include, but not limited to, biofuels (including ethanol); lactic acid; plastics; specialty chemicals; organic acids, including citric acid, succinic acid and maleic acid; solvents; animal feed supplements; pharmaceuticals; vitamins; amino acids, such as lysine, methionine, tryptophan, threonine, and aspartic acid; industrial enzymes, such as proteases, cellulases, amylases, glucanases, lactases, lipases, lyases, oxidoreductases, and transferases; and chemical feedstocks. The methods of the invention are also useful to generate feedstocks for fermentation by fermenting microorganisms. In one embodiment, the method further comprises the addition of at least one fermenting organism. As used herein, "fermenting organism" refers to an organism capable of fermentation, such as bacteria and fungi, including yeast. Such feedstocks have additional nutritive value above the nutritive value provided by the liberated sugars.

In some embodiments, the present invention provides methods for improving the nutritional quality of food (or animal feed) comprising adding to the food (or the animal feed) at least one protein of the present invention. In some embodiments, the present invention provides methods for improving the nutritional quality of the food (or animal feed) comprising pretreating the food (or the animal feed) with at least one isolated protein of the present invention. For instance, use of the enzymes xylanases and arabinofuranosidases in bread making has been known to improve the nutritional quality of the dough by degrading the arabinoxylans in the dough. Improving the nutritional quality can mean making the food (or the animal feed) more digestible and/or less allergenic, and encompasses changes in the caloric value, taste and/or texture of the food. In some embodiments, the proteins of the present invention may be used as part of nutritional supplements. In some embodiments, the proteins of the present invention may be used as part of digestive aids, and may help in providing relief from digestive disorders such as acid reflux and celiac disease.

Proteins of the present invention and compositions comprising at least one protein of the present invention are also useful in a variety of other applications involving the hydrolysis of glycosidic linkages in lignocellulosic material, such as stone washing, color brightening, depilling and fabric softening, as well as other applications well known in the art. Proteins of the present invention and compositions comprising at least one protein of the present invention are also readily amenable to use as additives in detergent and other media used for such applications. These and other methods of use will readily suggest themselves to those of skill in the art based on the invention described herein.

In one embodiment of this invention, proteins and compositions of the present invention can be used in stone washing procedures for fabrics or other textiles. In some embodiments, the proteins and compositions can be used in stone washing procedures for denim jeans. By way of example, the method for stone washing the fabric comprises contacting the fabric with a protein or composition of the present invention. In an additional embodiment, the protein or composition of the present invention is included in a detergent composition, as described below. A preferred pH range of stone wash applications is between about 5.5 to 7.5, most preferably at about pH 6 to about 7. One of skill in the art will know how to regulate the amount or concentration of the protein or composition produced by this invention based on such factors as the activity of the enzyme and the wash conditions, including but not limited to temperature and pH. Examples of these uses can be found in U.S. Patent Application Publication No. 2003/0157595, the contents of which are hereby incorporated by reference.

In yet another embodiment of this invention, the cellulase compositions of this invention can be used to reduce or eliminate the harshness associated with a fabric or textile by contacting the fabric or textile with a protein or composition of the present invention. In some embodiments, the fabric or textile may be made from cellulose or cotton. By way of example, a preferred range for reducing or eliminating the harshness associated with a fabric or textile is between about pH 8 to about 12, or between about pH 10 to about 11.

The proteins or compositions of the subject invention can be used in detergent compositions. In one embodiment, the detergent composition may comprise at least one protein or composition of the present invention and one or more surfactants. The detergent compositions may also include any additional detergent ingredient known in the art. Detergent ingredients contemplated for use with the detergent compositions of the subject invention include, but are not limited to, detergents, buffers, surfactants, bleaching agents, softeners, solvents, solid forming agents, abrasives, alkalis, inorganic electrolytes, cellulase activators, antioxidants, builders, silicates, preservatives, and stabilizers. The detergent compositions of this invention preferably employ a surface active agent, i.e., surfactant, including anionic, non-ionic, and ampholytic surfactants well known for their use in detergent compositions. In addition to the at least one protein or composition of the present invention and the surface active agent, the detergent compositions of this invention can additionally contain one or more of the following components: the enzymes amylases, cellulases, proteinase, lipases, oxido-reductases, peroxidases and other enzymes; cationic surfactants and long-chain fatty acids; builders; antiredeposition agents; bleaching agents; bluing agents and fluorescent dyes; caking inhibitors; masking agents for factors inhibiting the cellulase activity; cellulase activators; antioxidants; and solubilizers. In addition, perfumes, preservatives, dyes, and the like can be used, if desired, with the detergent compositions of this invention. Examples of detergent compositions employing cellulases are exemplified in U.S. Pat. Nos. 4,435,307; 4,443,355; 4,661,289; 4,479,881; 5,120,463, each of which is incorporated herein by reference in its entirety for all purposes.

When a detergent base used in the present invention is in the form of a powder, it may be one which is prepared by any known preparation method including a spray-drying method and/or a granulation method. The granulation method are the most preferred because of the non-dusting nature of granules compared to spray dry products. The detergent base obtained by the spray-drying method is hollow granules which are obtained by spraying an aqueous slurry of heat-resistant ingredients, such as surface active agents and builders, into a hot space. The granules have a size of from about 50 to about 2000 micrometers. After the spray-drying, perfumes, enzymes, bleaching agents, and/or inorganic alkaline builders may be added. With a highly dense, granular detergent base obtained by such as the spray-drying-granulation method, various ingredients may also be added after the preparation of the base. When the detergent base is a liquid, it may be either a homogenous solution or an inhomogeneous solution.

Other textile applications in which proteins and compositions of the present invention may be used include, but are not limited to, garment dyeing applications such as enzymatic mercerizing of viscose, bio-polishing applications, enzymatic surface polishing; biowash (washing or washing down treatment of textile materials), enzymatic microfibrillation, enzymatic "cottonization" of linen, ramie and hemp; and treatment of Lyocel or Newcell (i.e., "TENCEL" from Courtauld's), Cupro and other cellulosic fibers or garments, dye removal from dyed cellulosic substrates such as dyed cotton (Leisola & Linko—(1976) Analytical Biochemistry, v. 70, p. 592. Determination Of The Solubilizing Activity Of A Cellulase Complex With Dyed Substrates; Blum & Stahl—Enzymic Degradation Of Cellulose Fibers; Reports of the Shizuoka Prefectural Hamamatsu Textile Industrial Research Institute No. 24 (1985)), as a bleaching agent to make new indigo dyed denim look old (Fujikawa—Japanese Patent Application Kokai No. 50-132269), to enhance the bleaching action of bleaching agents (Suzuki—Great Britain Patent No. 2 094 826), and in a process for compositions for enzymatic desizing and bleaching of textiles (Windbichtler et al., U.S. Pat. No. 2,974,001. Another example of enzymatic desizing using cellulases is provided in Bhatawadekar (May 1983) Journal of the Textile Association, pages 83-86.

The amount of enzyme or enzyme composition contacted with a textile may vary with the particular application. Typically, for biofinishing and denim washing applications, from about 0.02 wt. % to about 5 wt. % of an enzyme or enzyme composition may be contacted with the textile. In some embodiments, from about 0.5 wt. % to about 2 wt. % of an enzyme or enzyme composition may be contacted with the textile. For bio scouring, from about 0.1 to about 10, or from about 0.1 to about 1.0 grams of an enzyme or enzyme composition per kilogram of textile may be used, including any amount between about 0.1 grams and about 10 grams, in increments of 0.1 grams.

In other embodiments, the proteins or compositions of the present invention can be used in the saccharification of lignocellulose biomass from agriculture, forest products, municipal solid waste, and other sources, for biobleaching of wood pulp, and for de-inking of recycled print paper all by methods known to one skilled in the art.

The amount of enzyme or enzyme composition used for pulp and paper modification (e.g., biobleaching of wood pulp, de-inking of paper, or biorefining of pulp for paper making) typically varies depending upon the stock that is used, the pH and temperature of the system, and the retention time. In certain embodiments, the amount of enzyme or enzyme composition contacted with the paper or pulp may be from about 0.01 to about 50 U; from about 0.1 to about 15 U; or from about 0.1 to about 5 U of enzyme or enzyme composition per dry gram of fiber, including any amount between about 0.01 and about 50 U, in 0.01 U increments. In other embodiments, the amount of enzyme or enzyme composition contacted with the paper or pulp may be from about 1 to about 2000 grams or from about 100 to about 500 grams enzyme or enzyme composition per dry ton of pulp, including any amount between about 1 and about 2000 grams, in 1 gram increments.

Proteins or compositions of the present invention can added to wastewater to reduce the amount of solids such as sludge or to increase total biochemical oxygen demand (BOD) and chemical oxygen demand (COD) removal. For example, proteins or compositions of the present invention can be used to transform particulate COD to soluble COD in wastewater produced from grain/fruit/cellulose industrial processes or to increase the BOD/COD ratio by increasing waste biodegradability (soluble lower molecular weight polymers in cellulosic/hemicellulosic wastes are typically more readily biodegradable than non-soluble material). In biological wastewater treatment systems, proteins or compositions of the present invention can also be used to increase waste digestion by aerobic and/or anaerobic bacteria.

Chitosanases of the present invention (e.g., SEQ ID NO:188) can hydrolyze the β-1,4-linkages between D-glucosamine residues in acetylated chitosan (i.e., deacetylated chitin) and thus may be used to degrade chitin- or chitosan-containing materials. Examples of chitin-containing materials include fungal cell walls, insect exoskeletons, the eggs of parasitic worms, and crustacean shells.

Chitosanases may be used to inhibit or reduce fungal growth, including the treatment of fungal infections such as those caused by nail fungi. For example, chitosanases of the present invention may be applied to any fungus or area susceptible to fungal growth. Chitosanases may also be used to coat or treat seeds and flower bulbs to prevent the growth of fungi. Further, chitosanases may be added to fungal cultures to lower culture viscosity by increasing cell wall degradation. Chitosanases may also by used as lysing enzymes for the generation of protoplasts from fungi (see, e.g., Yano et al., *Biosci Biotechnol Biochem.* 70:1754 (2006).

Chitosanases or compositions containing chitosanases may be used as a biological control agent such as an insecticide (see, e.g., Kramer et al., *Insect Biochem Mol. Biol.* 27:887 (1997). Chitin-degrading enzymes such as chitinases and chitosanases have been shown to be effective for controlling white-fly larvae in laboratory tests. Thus, chitosanases may be applied to crops, plants and the like to control insect infestations.

Chitin has also been suggested to play a role in inducing allergic inflammation and asthma (see Reese et al., *Nature* 447:92 (2007)). Accordingly, chitosanases of the present invention may be administered to a subject to reduce allergic inflammatory responses induced by chitin or to reduce the symptoms of asthma.

Exemplary methods according to the invention are presented below. Examples of the methods described above may also be found in the following references, all of which are incorporated herein in their entireties: *Trichoderma & Gliocladium*, Volume 2, Enzymes, biological control and commercial applications, Editors: Gary E. Harman, Christian P. Kubicek, Taylor & Francis Ltd. 1998, 393 (in particular, chapters 14, 15 and 16); Helmut Uhlig, Industrial enzymes and their applications, Translated and updated by Elfriede M. Linsmaier-Bednar, John Wiley & Sons, Inc 1998, p. 454 (in particular, chapters 5.1, 5.2, 5.3, 5.4, 5.5, 5.6, 5.7, 5.9, 5.10, 5.11, and 5.13). For saccharification applications: Hahn-Hägerdal, B., Galbe, M., Gorwa-Grauslund, M. F. Lidén, Zacchi, G. Bio-ethanol—the fuel of tomorrow from the residues of today, *Trends in Biotechnology,* 2006, 24 (12), 549-556; Mielenz, J. R. Ethanol production from biomass: technology and commercialization status, *Current Opinion in Microbiology,* 2001, 4, 324-329; Himmel, M. E., Ruth, M. F., Wyman, C. E., Cellulase for commodity products from cellulosic biomass, *Current Opinion in Biotechnology,* 1999, 10, 358-364; Sheehan, J., Himmel, M. Enzymes, energy, and the environment: a strategic perspective on the U.S. Department of Energy's Research and Development Activities for Bioethanol, *Biotechnology Progress.* 1999, 15, 817-827. For textile processing applications: Galante, Y. M., Formantici, C., Enzyme applications in detergency and in manufacturing industries, *Current Organic Chemistry,* 2003, 7, 1399-1422. For pulp and paper applications: Bajpai, P., Bajpai, P. K Deinking with enzymes: a review. *TAPPI Journal,* 1998, 81(12), 111-117; Viikari, L., Pere, J., Suurnäkki, A., Oksanen, T., Buchert, J. Use of cellulases in pulp and paper applications. In: "*Carbohydrates from Trichoderma reesei and other microorganisms. Structure, Biochemistry, Genetics and Applications.*" Editors: Mark Claessens, Wim Nerinckx, and Kathleen Piens, The Royal Society of Chemistry 1998, 245-254. For food and beverage applications: Roller, S., Dea, I. C. M. Biotechnology in the production and modification of biopolymers for foods, *Critical Reviews in Biotechnology,* 1992, 12(3), 261-277.

Each publication or reference cited herein is incorporated herein by reference in its entirety for all purposes.

The following examples are provided for the purpose of illustration and are not intended to limit the scope of the present invention.

EXAMPLES

Example 1

The following example illustrates the assay used to measure the •-arabinofuranosidase enzymatic activity.

This assay measured the release of p-nitrophenol by the action of α-arabinofuranosidase on p-nitrophenyl α-L-arabinofuranoside (PNPA). One α-arabinofuranosidase unit of activity is the amount of enzyme that liberates 1 micromole of p-nitrophenol in one minute at 37° C. and pH 5.0.

Acetate buffer (0.1 M, pH 5.0) was prepared as follows: 8.2 g of anhydrous sodium acetate or 13.6 g of sodium acetate*3$H_2O$ was dissolved in distilled water so that the final volume of the solution was 1000 ml (Solution A). In a separate flask, 6.0 g (5.72 ml) of glacial acetic acid was mixed with distilled water to make the total volume of 1000 ml (Solution B). The final 0.1 M acetate buffer, pH 5.0, was prepared by mixing Solution A with Solution B until the pH of the resulting solution was equal to 5.0.

PNPA (Fluka, Switzerland, cat. #73616) was used as the assay substrate. 8.25 mg of PNPA was dissolved in 5 mL of distilled water and 5 mL 0.1 M acetate buffer using a magnetic stirrer to obtain a 1 mM stock solution. The solution was stable for 2 days with storage at 4° C.

The stop reagent (0.25 M sodium carbonate solution) was prepared as follows: 26.5 g of anhydrous sodium carbonate was dissolved in 800 ml of distilled water, and the solution volume was adjusted to 1000 ml. This reagent was used to terminate the enzymatic reaction.

For the enzyme sample, 0.10 mL of 1 mM PNPA stock solution was mixed with 0.01 mL of the enzyme sample and incubated at 37° C. for 90 minutes. After 90 minutes of incubation, 0.1 mL of 0.25 M sodium carbonate solution was added and the absorbance at 405 nm ($A_{405}$) was then measured in microtiter plates as $A_S$.

For the substrate blank, 0.10 mL of 1 mM PNPA stock solution was mixed with 0.01 mL of 0.05 M acetate buffer, pH 5.0. 0.1 mL of 0.25 M sodium carbonate solution was then added and the absorbance at 405 nm ($A_{405}$) was measured in microtiter plates as $A_{SB}$.

Activity was calculated as follows:

$$\text{Activity (IU/ml)} = \frac{\Delta A_{405} * DF * 21 * 1.33}{13.700 * 90}$$

where $\Delta A_{405} = A_S - A_{SB}$, DF is the enzyme dilution factor, 21 is the dilution of 10 µl enzyme solution in 210 µl reaction volume, 1.33 is the conversion factor of microtiter plates to cuvettes, 13.700 is the extinction coefficient 13700 $M^{-1} cm^{-1}$ of p-nitrophenol released corrected for mol/L to µmol/mL, and 90 minutes is the reaction time.

Using the above assay, the α-arabinofuranosidase activity of Abn4 was found to be 0.005 IU/mL ($\Delta A_{405}$=0.200, DF=1) and the α-arabinofuranosidase activity Abn5 was found to be 0.008 IU/ml ($\Delta A_{405}$=0.370, DF=1). Both enzymes were produced by microtiterplate cultures.

The assay above was also performed with a 2 mM PNPA stock solution (16.5 mg of PNPA dissolved in 5 mL of distilled water and 5 mL 0.1 M acetate buffer) and a 30 minute reaction time (making the necessary substitution of 30 minutes reaction time in the activity calculation equation above). Using this assay, the α-arabinofuranosidase activity of Abn7 was found to be 0.028 IU/mL ($\Delta A_{405}$=0.410, DF=1). The enzyme was produced by microtiterplate cultures.

Example 2

The following example illustrates the assay used to measure the ability of enzymes of the present invention to remove the •-L-arabinofuranosyl residues from double substituted xylose residues.

For the complete degradation of arabinoxylans to arabinose and xylose, several enzyme activities are needed, including endo-xylanases and arabinofuranosidases. The arabinoxylan molecule from wheat is highly substituted with arabinosyl residues. These can be substituted either to the $C_2$ or the $C_3$ position of the xylosyl residue (single substitution), or both to the $C_2$ and $C_3$ position of the xylose (double substitution). An arabinofuranosidase from *Bifidobacterium adolescentis* (AXHd$_3$) has previously been isolated which was able to liberate the arabinosyl residue substituted to the $C_3$ position of a double substituted xylose (Van Laere et al. 1997, Van den Broek et al. 2005). Most of the known arabinofuranosidases are only active towards single arabinosyl substituted xyloses.

Single and double substituted oligosaccharides were prepared by incubating wheat arabinoxylan (WAX; 10 mg/mL; Megazyme, Bray, Ireland) in 50 mM acetate buffer pH 5 with 0.3 mg Pentopan Mono (monocomponent endo-1,4-β-xylanase, an enzyme from *Thermomyces lanuginosus* produced in *Aspergillus oryzae*; Sigma, St. Louis, USA) for 16 hours at 30° C. The reaction was stopped by heating the samples at 100° C. for 10 minutes. The samples were centrifuged for 5 minutes at 3100×g. The supernatant was used for further experiments. Degradation of the arabinoxylan was followed by analysis of the formed reducing sugars and High Performance Anion Exchange Chromatography (HPAEC).

Double substituted arabinoxylan oligosaccharides were prepared by incubation of 800 µl of the supernatant described above with 0.18 mg of the arabinofuranosidase Abf1 (Abf1 is arabinofuranosidase from *C. lucknowense* with activity towards single arabinose substituted xylose residues and is disclosed in U.S. application Ser. No. 11/833,133, filed Aug. 2, 2007, the contents of which are incorporated herein by reference) in 50 mM acetate buffer pH 5 for 20 hours at 30° C. The reaction was stopped by heating the samples at 100° C. for 10 minutes. The samples were centrifuged for 5 minutes at 10,000×g, and the supernatant was used for further experiments. Degradation of the arabinoxylan was followed by analysis of the formed reducing sugars and HPAEC.

The activity towards p-nitrophenyl-α-L-arabinofuranoside (pNP-ara) or p-nitrophenyl-β-D-xylopyranoside (pNP-xyl) was measured at 37° C. after 10 minutes of incubation. The reaction mixture (110 µl) consisted of 1.5 mg/ml pNP-ara or pNP-xyl solution, 50 µg Abn7 (total protein) in 50 mM sodium acetate buffer pH 5.0. The reaction was stopped by adding 100 µt of 01.25 M $NaCO_3$ pH 8.5. The color formation was then measured at 405 nm. One unit of activity was defined as 1 µmol of arabinose liberated per min under the specified conditions. The molar extinction coefficient under these assay conditions was 13,700 l/M*cm.

Abn7 (25 µg total protein) was incubated with single and double substituted arabinoxylan oligosaccharides (100 µL supernatant of Pentopan Mono treated WAX) in 50 mM acetate buffer at 30° C. during 20 hours. The reaction was stopped by heating the samples at 100° C. for 10 minutes. The samples were centrifuged for 5 minutes at 10,000×g. Degradation of the arabinoxylan was followed by analysis of the formed reducing sugars and HPAEC.

Abn7 (25 µg total protein) or AXHd$_3$ from *B. adolescentis* (10 µl, 0.02 U; Megazyme, Bray, Ireland) was incubated with double substituted arabinoxylan oligosaccharides (125 µl supernatant of Pentopan Mono and Abf1 treated WAX) in 50 mM acetate buffer at 35° C. during 24 hours. The reaction was stopped by heating the samples at 100° C. for 10 minutes. The samples were centrifuged for 5 minutes at 10,000×g. Degradation of the arabinoxylan was followed by analysis of the formed reducing sugars and HPAEC.

The amount of reducing sugars was measured with help of the DNS (3,5-dinitrosalicylic acid) assay. 0.5 mL of DNS reagent (3,5-dinitrosalicylic acid and sodium potassium tartrate dissolved in dilute sodium hydroxide) is added to the sample (50 µl), containing 0-5 mg/ml reducing sugar. The reaction mixture was heated at 100° C. for 5 minutes and rapidly cooled in ice to room temperature. The absorbance at 570 nm was measured. Glucose was used as a standard.

The analysis of the samples via HPAEC was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.3 mil/min was used with the following gradient of sodium acetate in 0.1 M NaOH: 0-5 minutes, 0-100 mM; 5-45 minutes, 100-400 mM. Each elution was followed by a washing step of 5 minutes 1 M sodium acetate in 0.1 M NaOH and an equilibration step of 15 minutes 0.1 M NaOH. Peaks were identified according to Kormelink et al., 1993 and Gruppen et al., 1992.

Using the assays described above, the enzyme Abn7 was found to have arabinofuranosidase activity of about 1.21 U/ml in end-of-fermentation samples when pNP-ara is used as a substrate.

Single and double substituted arabinoxylan oligosaccharides were prepared by xylanase treatment as described above. After overnight incubation, the amount of reducing sugars increased from 0 to 4.3 mM (glucose was used as the standard). The addition of an extra amount of enzyme did not increase this number, indicating that the reaction was at an end point. Assuming that the average degree of polymerization was 3, 1.8 mg of oligosaccharides were formed, which corresponds to 30% of WAX degradation. The HPAEC diagram of the resulting oligosaccharide solution is shown in FIG. 1, line A. Oligosaccharides were identified according to Kormelink et al., 1993 and Gruppen et al., 1992. In addition to non-substituted oligosaccharides (xylobiose ($X_2$), xylotriose ($X_3$), xylotetraose ($X_4$)), single ($X_3A$, $X_2A$) and double substituted ($X_4A_2$, $X_3A_2$) oligosaccharides were also present after xylanase treatment.

The activity of Abn7 towards this mixture of arabinoxylan oligosaccharides was then determined using the assays described above. The HPAEC diagram of this reaction is shown in FIG. 1, line B. While the double substituted oligosaccharides ($X_4A_2$ and $X_3A_2$) disappear after Abn7 treatment, arabinose and newly formed single substituted oligosaccharides (A and $X_3A$) were also found. The lower peak area of the oligosaccharide $X_2A$ in the Abn7-treated sample might indicated that the enzyme is also able to degrade single substituted arabinoxylan oligosaccharides.

Figure 2:
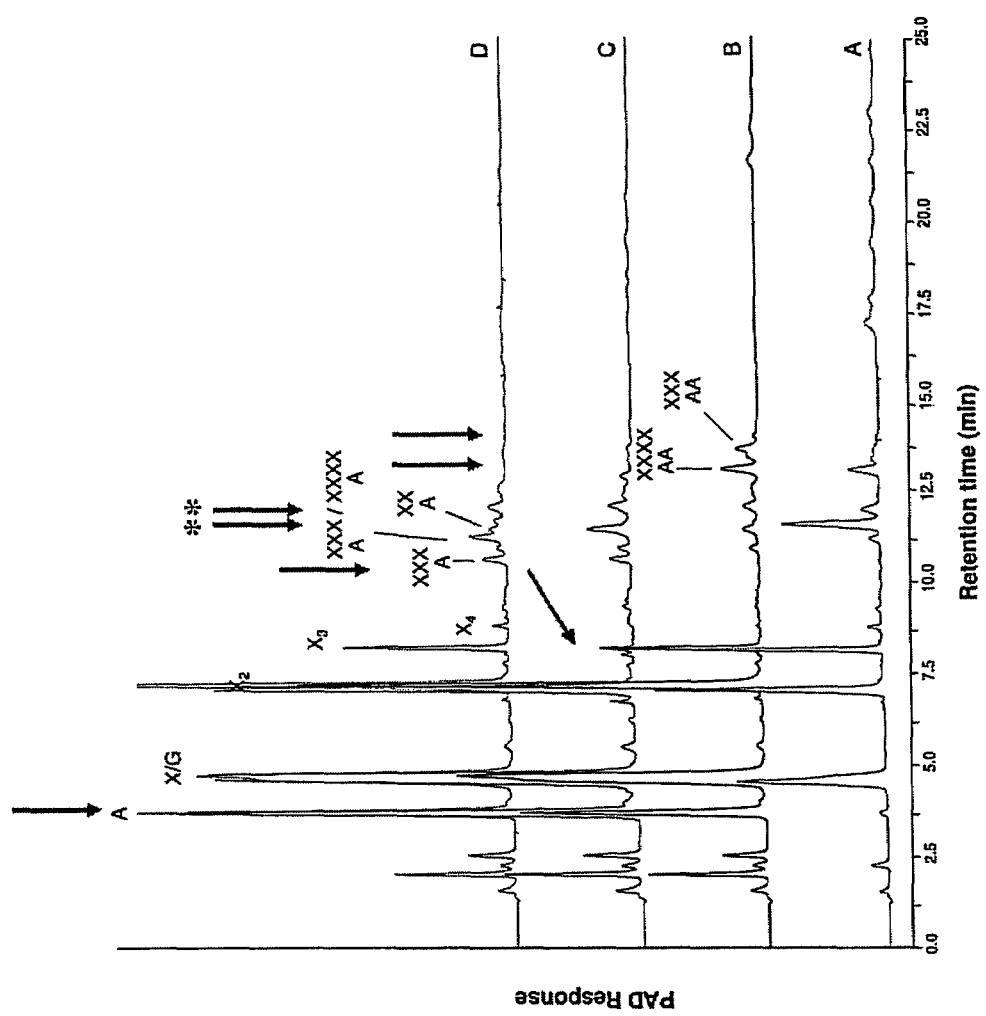
FIG. 2 shows HPAEC diagrams of wheat arabinoxylan (WAX) incubated with the enzyme Pentopan (A), WAX incubated with Pentopan followed by Abf1 (B), WAX incubated with Pentopan followed by Abf1 and Abn7 (C), and WAX incubated with Pentopan followed by Abf1 and AXHd$_3$ from B. adolescentis (D). A indicates arabinose, while X indicates xylose.

To generate samples with only double substituted oligosaccharides present, the single substituted oligosaccharides were removed from the xylanase-treated WAX mixture by the enzyme Abf1 as described above. The HPAEC diagrams of the xylanase treated WAX mixture (line A) and the Abf1- and xylanase-treated WAX mixture (line B) are shown in FIG. 2. This was done to confirm which peaks correspond to the single and double substituted oligosaccharides.

Samples containing only double substituted oligosaccharides were treated with Abn7 or $AXHd_3$ from *B. adolescentis* as a reference enzyme as described above. FIG. 2 shows the results of the Abn7-treated (line C) and the $AXHd_3$-treated samples (Line D). As shown in FIG. 2, the doubly substituted arabinoxylan oligosaccharides ($X_4A_2$ and $X_3A_2$) were degraded by both Abn7 and $AXHd_3$ treatment, forming arabinose and mono-substituted oligosaccharides (A, $X_2A$, $X_3A$ and $X_4A$). The degradation pattern Abn7 and $AXHd_3$ were similar, except that Abn7 was observed to form more $X_2A$, whereas $AXHd_3$ formed more $X_3A$ and/or $X_4A$ (see arrows with stars). $X_3$ was also found to be degraded by Abn7 (slanted arrow). The increase in xylose (X; seen in X/G peak) suggested that Abn7 also possesses β-xylosidase activity. Combining all the data, it was concluded that Abn7 demonstrates the ability to remove arabinose residues from double substituted xylose residues and also possesses β-xylosidase activity.

Despite the similar enzymatic activities, Abn7 was found to have only 29% amino acid identity with $AXHd_3$ from *B. adolescentis*.

Example 3

The following examples illustrates the assay used to measure Xyloglucanase activity. Such activity was demonstrated by using xyloglucan as substrate and a reducing sugars assay (PAHBAH) as detection method. The values were compared to a standard, which was prepared using a commercial cellulase preparation from *Aspergillus niger*.

Reagents

The cellulase standard solution was prepared, which contained 2 units of cellulase per ml of 0.2 M HAc/NaOH, pH 5. Subsequently, a standard series of 0 to 2 U/ml was prepared (12 samples).

Reagent A: 10 g of p-Hydroxy benzoic acid hydrazide (PAHBAH) was suspended in 60 mL water. 10 mL of concentrated hydrochloric acid was added and the volume was adjusted to 200 ml. Reagent B: 24.9 g of trisodium citrate was dissolved in 500 ml of water. To this solution 2.2 g of calcium chloride and 40 g sodium hydroxide were added. The volume was adjusted to 2 L with water. Both reagents were stored at room temperature. Working Reagent: 10 ml of Reagent A was added to 90 ml of Reagent B. This solution was prepared freshly every day, and was stored on ice between uses.

Using the above reagents, the assay was performed as detailed below

Enzyme Sample

The assay was conducted in micro titer plate format. Each well contained 50 µl of xyloglucan substrate (0.25% (w/v) tamarind xyloglucan in water), 30 µl of 0.2 M HAc/NaOH pH 5, 20 µl xyloglucanase sample or cellulase standard sample. These were incubated at 37° C. for 2 hours. After incubation 25 µl of each well were mixed with 125 µl working reagent. These solutions were heated at 95° C. for 5 minutes. After cooling down, the samples were analyzed by measuring the absorbance at 410 nm ($A_{410}$) as $A_s$ (enzyme sample). The standard curve was determined and from that the Xgl1 activities were determined.

Substrate Blank

50 µL of xyloglucan substrate (0.25% (w/v) tamarind xyloglucan in water) was mixed with 50 µL 0.2 M sodium acetate buffer pH 5.0 and incubated at 37° C. for 2 hours. To 25 µL of this reaction mixture, 125 µL of working solution was added. The samples were heated for 5 minutes at 95° C. After cooling down, the samples were analyzed by measuring the absorbance at 410 nm ($A_{410}$) as $A_{SB}$ (substrate blank sample).

Calculation of Activity

Activity was calculated as follows: xyloglucanase activity was determined by reference to a standard curve of the cellulase standard solution.

$$\text{Activity(IU/ml)} = \Delta A_{410}/SC*DF$$

where $\Delta A_{410} = A_S$ (enzyme sample) $- A_{SB}$ (substrate blank), SC is the slope of the standard curve and DF is the enzyme dilution factor.

Results

Xgl1 showed an activity exceeding the 2 U/ml value of the highest standard sample (absorbance at 410 nm>1.9), whereas the negative control exhibited an absorbance at 410 nm of only 0.25.

Example 4

The following example illustrates the assay used to measure the ability of the enzymes of the present invention to bind to bacitracin-sepharose. Since sepharose consists of cross-linked agarose molecules, which are composed of alternating galactose residues linked by β-1,3 and β-1,4 linkages, binding to agarose indicates the presence of a carbohydrate binding module (CBM) in the enzyme. Bacitracin is a polypeptide to which only proteases are expected to bind.

Reagents 4 g of CNBr-activated Sepharose 4B was washed on a glass filter G3 with 800 mL 1 mM HCl, followed by 20 mL 0.1M NaHCO$_3$ pH8.3+0.5M NaCl (solution A). The gel was added to a 50 mL tube. 300 mg bacitracin was dissolved in 10 mL solution A and was added to the Sepharose gel. The bacitracin-sepharose gel was incubated overnight at 4° C. under constant stirring. The gel was washed on a glass filter G3 with 30 mL solution A and 30 mL 0.1M NaAc/HAc pH4.0+0.5M NaCl (solution B). This washing step was repeated twice. Subsequently, the gel was washed with 30 mL solution A. The gel was transferred to a 50 mL tube and 20 mL 0.1M Tris/HCl pH8.0 (Solution C) was added. The tube was incubated for 2.5 hours at room temperature under constant stirring. The gel was washed with 70 ml of solution A and subsequently with 50 ml of solution C. The gel was stored at 4° C. in solution C.

The bacitracin-sepharose gel can be regenerated by washing it with alternating 100 ml 0.1M Tris/HCl pH 8.5 containing 0.5M NaCl, or 100 ml sodium acetate buffer pH 4.5 containing 0.5M NaCl.

Isolation of Enzyme Sample with Bacitracin-Sepharose

The fermentation broth containing the target enzyme was dialyzed overnight against 25 mM sodium acetate buffer, pH 4.0 at 4° C. and subsequently filtered through a 0.45 µm filter. A plastic column (6.8×150 mm) was filled with 2 ml of the bacitracin-sepharose and subsequently equilibrated with 10 ml of 25 mM sodium acetate buffer pH4.0. The dialyzed fermentation broth was loaded to the column and the column was washed with 25 mM sodium acetate buffer pH4.0. The bound proteins were eluted with 10 mL 0.1M Tris/HCl pH 8.0 and analyzed by MS/MS to confirm their identity.

Results

The enzymes CL01467, CL02507, CL05366, and CDH1 were bound to the bacitracin-sepharose column, indicating that these enzymes contain a carbohydrate binding module.

Example 5

The following example illustrates the assay used to measure the α-glucuronidase activity towards arabinoxylan oligosaccharides from *Eucalyptus* wood. This assay measured the release of glucuronic acid by the action of the α-glucuronidase on the arabinoxylan oligosaccharides.

Reagents

Sodium acetate buffer (0.01 M, pH 5.0) was prepared as follows. 0.82 g of anhydrous sodium acetate or 1.36 g of sodium acetate*3H$_2$O was dissolved in distilled water to a final volume of 1000 mL (Solution A). In a separate flask, 0.6 g (0.572 mL) of glacial acetic acid was mixed with distilled water to make the total volume of 1000 mL (Solution B). The final 0.01 M sodium acetate buffer, pH 5.0, was prepared by mixing Solution A with Solution B until the pH of the resulting solution was equal to 5.0.

Acetylated, 4-O-MeGlcA substituted xylo-oligosaccharides with 2-4 xylose residues or 4-10 xylose residues from *Eucalyptus* wood (EW-XOS) were prepared using the method described in Kabel et al., 2002. 1 mg of xylo-oligosaccharides was dissolved in 1 mL distilled water using magnetic stirrer. 4-O-MeGlcA was purified by using the method described in Kabel et al. 2002. Aldo-biuronic acid (X$_1$G), aldo-triuronic acid (X$_2$G), and aldo-tetrauronic acid (X$_3$G) were obtained from Megazyme.

To remove the acetyl groups in the XOS, either for reference or for substrates, 1 mg of substrate was dissolved in 120 •L Millipore water and 120 •L 0.1 M NaOH. After overnight incubation at 4° C., the pH of the samples was checked. A pH above 9.0 indicated that the saponification reaction was complete. 120 •L of 0.1 M acetic acid and 40 •L of 0.2 M Sodium acetate, pH 5.0 were added. After following these steps, the substrate concentration was 2.5 mg/mL in 50 mM sodium acetate buffer, pH 5.0.

Enzyme Sample 1.0 mL of xylo-oligosaccharides stock solution was mixed with 0.68 µg of the enzyme sample and incubated at 35° C. for 24 hours. The reaction was stopped by heating the samples for 10 minutes at 100° C. The release of 4-O-methyl glucuronic acid and formation of new (arabino)xylan oligosaccharides were analyzed by High Performance Anion Exchange Chromatography and Capillary Electrophoresis.

Substrate Blank 1.0 mL of arabinoxylan oligosaccharides stock solution was mixed with 0.68 µg of distilled water and incubated at 35° C. for 24 hours. The reaction was stopped by heating the samples for 10 minutes at 100° C. The release of glucuronic acid and formation of new arabinoxylan oligosaccharides were analyzed by High Performance Anion Exchange Chromatography and Capillary Electrophoresis.

High Performance Anion Exchange Chromatography

The analysis was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.3 mL/min was used with the following gradient of sodium acetate in 0.1 M NaOH: 0-50 min, 0-500 mM. Each elution was followed by a washing step of 5 min using 1 M sodium acetate in 0.1 M NaOH and an equilibration step of 15 min using 0.1 M NaOH.

Capillary Electrophoresis-Laser Induced Fluorescence Detector (CE-LIF)

Samples containing about 0.4 mg of EW-XOS were substituted with 5 nmol of maltose as an internal standard. The samples were dried using centrifugal vacuum evaporator (Speedvac). 5 mg of APTS labeling dye (Beckman Coulter) was dissolved in 48 •L of 15% acetic acid (Beckman Coulter). The dried samples were mixed with 2 •L of the labeling dye solution and 2 •L of 1 M Sodium Cyanoborohydride (THF, Sigma-Aldrich). The samples were incubated overnight in the dark to allow the labeling reaction to be completed. After overnight incubation, the labeled samples were diluted 100 times with Millipore water before analysis by CE-LIF.

CE-LIF was performed using ProteomeLab PA800 Protein Characterization System (Beckman Coulter), controlled by 32 Karat Software. The capillary column used was polyvinyl alcohol coated capillary (N—CHO capillary, Beckman Coulter), with 50 •m ID, 50.2 cm length, 40 cm to detector window. 25 mM sodium acetate buffer pH 4.75 containing 0.4% polyethyleneoxide (Carbohydrate separation buffer, Beckman Coulter) was used as running buffer. The sample (about 3.5 nL) was injected to the capillary by a pressure of 0.5 psi for 3 seconds. The separation was done for 20 minutes at 30 kV separating voltage, with reversed polarity. During analysis, the samples were stored at 10° C. The labeled XOS were detected using LIF detector at 488 nm excitation and 520 nm emission wavelengths.

Determination of pH and Temperature Optimum

The pH optimum of Agu1 was determined by analyzing its activity at pH 4, 5, 6, and 7. The substrate was dissolved in McIlvain's buffer at the pH of analysis. The incubation was done at 35° C. The temperature optimum of the enzyme was determined by analyzing its activity at 35° C., 40° C., 50° C., 55° C., 60° C., 65° C., and 70° C. The substrate was dissolved in McIlvain's buffer at the pH optimum obtained from the previous experiment.

Results

Figure 3:
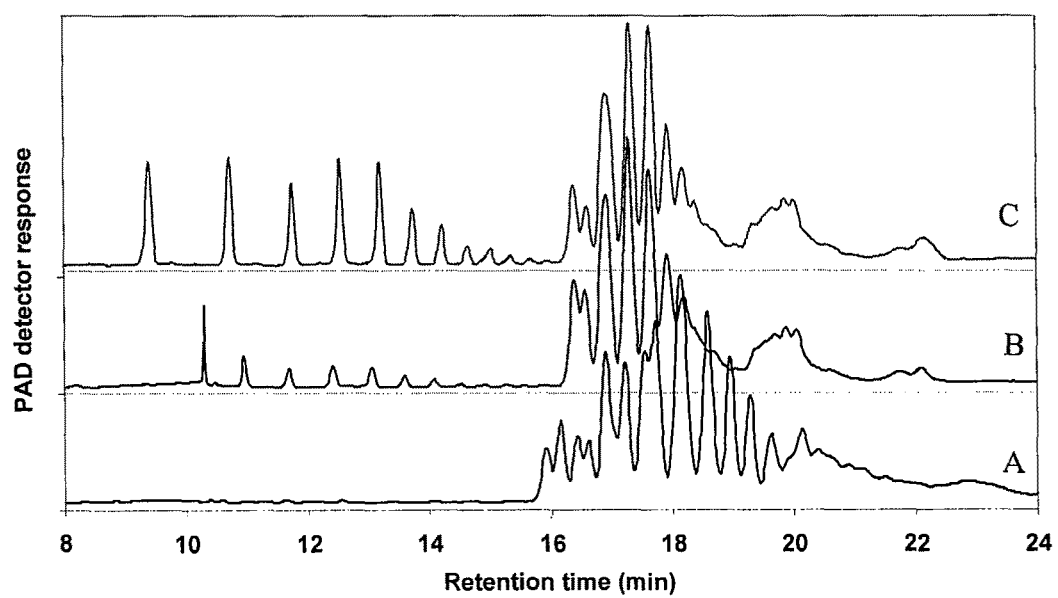
FIG. 3 shows HPAEC spectra of EW-XOS or saponified EW-XOS before digestion (A), after digestion of EW-XOS by Agu1 (B), and after digestion of saponified EW-XOS by Agu1 (C). The experiments were performed at pH 6.0, 40° C.
Figure 4:
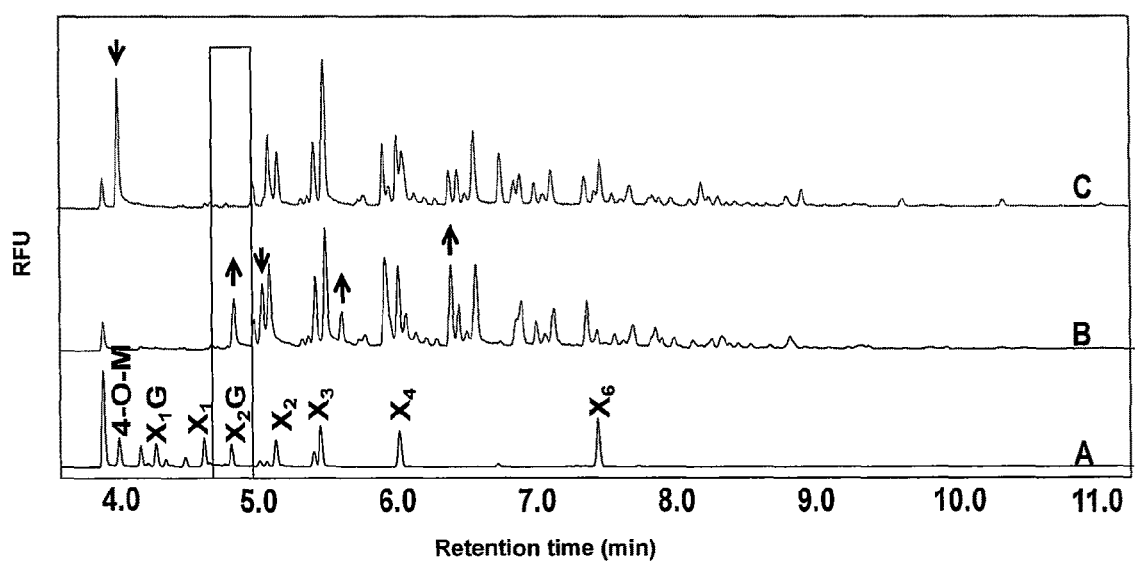
FIG. 4 shows CE electropherograms of a standard mixture (A), saponified EW-XOS (B) and saponified EW-XOS digested with Agu1 (C). The experiments were performed at pH 6.0, 40° C. during 24 hours. The arrows indicate the peaks of XOS that changed by the action of Agu1. X indicates xylose, G indicates glucuronic acid and 4-O-M indicates 4-O-methyl glucuronic acid.

The optimal pH of Agu1 was found to be 6 and the optimal temperature was found to be 50° C. Agu1 was found to release 4-O-methyl glucuronic acid from *Eucalyptus* wood xylo-oligosaccharides, since unsubstituted xylo-oligosaccharides were formed after digestion with Agu1 (as indicated in FIG. 3B). Release of 4-O-methyl glucuronic acid was observed. See FIG. 4C. Due to the action of Agu1, $X_2G$ was degraded. The standard mixture was composed of separate oligosaccharides, (mostly purchased from Megazyme). The $X_2G$ was known to have the glucuronic acid (G) at the non-reducing end of the molecule. Degradation of this substrate indicated that the Agu1 was able to hydrolyze the 4-O-methyl glucuronic acid which is located at the non-reducing end of xylo-oligosaccharides, as indicated in FIG. 4. It was also found that the activity of Agu1 was hindered by the presence of acetyl esters in the oligosaccharides, since saponification of the substrate increased the release of unsubstituted xylo-oligosaccharides (FIG. 3C).

REFERENCE

Kabel M A, Schols H A, Voragen A G J (2002). Complex xylo-oligosaccharides identified from hydro-thermally treated *Eucalyptus* wood and brewery's spent grain. Carbohdr. Polym. 50: 191-200.

Example 6

The following example illustrates the assay used to measure arabinofuranosidase activity. This assay measured the release of p-nitrophenol by the action of α-arabinofuranosidase on p-nitrophenyl α-L-arabinofuranoside (PNPA). One α-arabinofuranosidase unit of activity is the amount of enzyme that liberates 1 micromole of p-nitrophenol in one minute at 37° C. and pH 5.0.

Reagents

Sodium acetate buffer (0.1 M, pH 5.0) was prepared as follows. 8.2 g of anhydrous sodium acetate or 13.6 g of sodium acetate*3$H_2O$ was dissolved in distilled water to a final volume of 1000 mL (Solution A). In a separate flask, 6.0 g (5.72 mL) of glacial acetic acid was mixed with distilled water to make the total volume of 1000 mL (Solution B). The final 0.1 M sodium acetate buffer, pH 5.0, was prepared by mixing Solution A with Solution B until the pH of the resulting solution was 5.0.

PNPA from Fluka (Switzerland, cat. #73616) was used as the assay substrate. 16.5 mg of PNPA was dissolved in 5 mL of distilled water and 5 mL 0.1 M sodium acetate buffer using magnetic stirrer to obtain 2 mM stock solution. The solution was stable for 2 days on storage at 4° C.

The stop reagent (0.25 M sodium carbonate solution) was prepared as follows. 26.5 g of anhydrous sodium carbonate was dissolved in 800 mL of distilled water, and the solution volume was adjusted to 1000 mL. This reagent was used to terminate the enzymatic reaction.

Using the above reagents, the assay was performed as detailed below.

Enzyme Sample 0.10 mL of 2 mM PNPA stock solution was mixed with 0.01 mL of the enzyme sample and incubated at 37° C. for 30 minutes. After exactly 30 minutes of incubation, 0.1 mL of 0.25 M sodium carbonate solution was added and then the absorbance at 405 nm ($A_{405}$) was measured in microtiter plates as $A_S$ (enzyme sample).

Substrate Blank 0.10 mL of 2 mM PNPA stock solution was mixed with 0.01 mL of 0.05 M sodium acetate buffer, pH 5.0. 0.1 mL of 0.25 M sodium carbonate solution was added and the absorbance at 405 nm ($A_{405}$) was measured in microtiter plates as $A_{SB}$ (substrate blank).

Calculation of Activity

Activity was calculated as follows:

$$\text{Activity (IU/ml)} = \frac{\Delta A_{405} * DF * 21 * 1.33}{13.700 * 30}$$

where $\Delta A_{405} = A_S$ (enzyme sample) $-A_{SB}$ (substrate blank), DF is the enzyme dilution factor, 21 is the dilution of 10 μl enzyme solution in 210 μl reaction volume, 1.33 is the conversion factor of microtiter plates to cuvettes, 13.700 is the extinction coefficient 13700 $M^{-1}$ $cm^{-1}$ of p-nitrophenol released corrected for mol/L to μmol/mL, and 30 minutes is the reaction time.

Results

The $\Delta A_{405}$ of Abf3 was found to be >3.0 with a DF of 1 for enzyme produced in microtiter plate cultures. The enzyme solution was not diluted to obtain an $A_{405}$ between 0.05 and 1.0 units of optical density, which may affect activity calculation. From these results it was concluded that the enzyme is active towards p-nitrophenyl α-L-arabinofuranoside.

The $\Delta A_{405}$ of $\Delta A_{405}$ was found to be 0.12 IU/mL ($\Delta A_{405}=1.15$, DF=1, 20 minutes incubation) of enzyme produced in 1.5 L fermentations.

Example 7

The following example illustrates the assay used to measure arabinofuranosidase activity. This assay measured the release of arabinose by the action of the α-arabinofuranosidase on wheat arabinoxylan oligosaccharides (WAX).

Reagents

Sodium acetate buffer (0.05 M, pH 5.0) was prepared as follows. 4.1 g of anhydrous sodium acetate or 6.8 g of sodium acetate*3$H_2O$ was dissolved in distilled water to a final volume of 1000 mL (Solution A). In a separate flask, 3.0 g (2.86 mL) of glacial acetic acid was mixed with distilled water to make the total volume of 1000 mL (Solution B). The final 0.05 M sodium acetate buffer, pH 5.0, was prepared by mixing Solution A with Solution B until the pH of the resulting solution was equal to 5.0.

Wheat arabinoxylan oligosaccharides were prepared by degradation of Wheat arabinoxylan (Megazyme, Bray Ireland, Cat. # P-WAXYI) by endo-xylanase I from *A. niger* (enzyme collection Laboratory of Food Chemistry, Wageningen University, The Netherlands) or with Pentopan Mono (sigma, St. Louis, USA). 50 mg of WAX was dissolved in 10 mL 0.05 M sodium acetate buffer pH 5.0 using magnetic stirrer. 1.0 mL of WAX stock solution was mixed with 0.0075 mg of the endo-xylanase I from *A. niger* or 0.015 mg of the Pentopan Mono and incubated at 35° C. for 24 hours. The reaction was stopped by heating the samples for 10 minutes at 100° C. The residual material was removed by centrifugation (15 minutes at 14000 rpm), the supernatant was used as reagents. The assay was performed as detailed below.

Cellodextrins were purchased from Toronto Research Chemicals.

Enzyme Sample

100 μL of substrate stock solution was mixed with 0.004 mg (total protein) of enzyme sample and the reaction mixture was adjusted to 200 μL with 0.05 M sodium acetate buffer, pH 5.0. This mixture was incubated at 37° C. for 24 hours. The reaction was stopped by heating the samples for 10 minutes at 100° C. The release of arabinose and formation of new arabinoxylan oligosaccharides (from WAX) or the release of glucose and formation of new gluco-oligosaccharides (cellodextrins) were analyzed by High Performance Anion Exchange Chromatography.

Substrate Blank

100 μL of substrate stock solution was mixed with 100 μL 0.05 M sodium acetate buffer pH 5.0 and incubated at 37° C. for 24 hours. The reaction was stopped by heating the samples for 10 minutes at 100° C. The release of arabinose and formation of new arabinoxylan oligosaccharides (from WAX) or the release of glucose and formation of new gluco-oligosaccharides (cellodextrins) were analyzed by High Performance Anion Exchange Chromatography.

High Performance Anion Exchange Chromatography

The analysis was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.3 mL/min was used with the following gradient of sodium acetate in 0.1 M NaOH: 0-50 min, 0-500 mM. Each elution was followed by a washing step of 5 min 1,000 mM with sodium acetate in 0.1 M NaOH and an equilibration step of 15 min with 0.1 M NaOH.

Determination of pH Optimum

The pH optimum was determined by analyzing activity at pH 3, 4, 5, 6, 7, and 8. The substrate was dissolved in McIlvain's buffer at the pH of analysis. The incubation was done at 35° C.

Results

Figure 5:
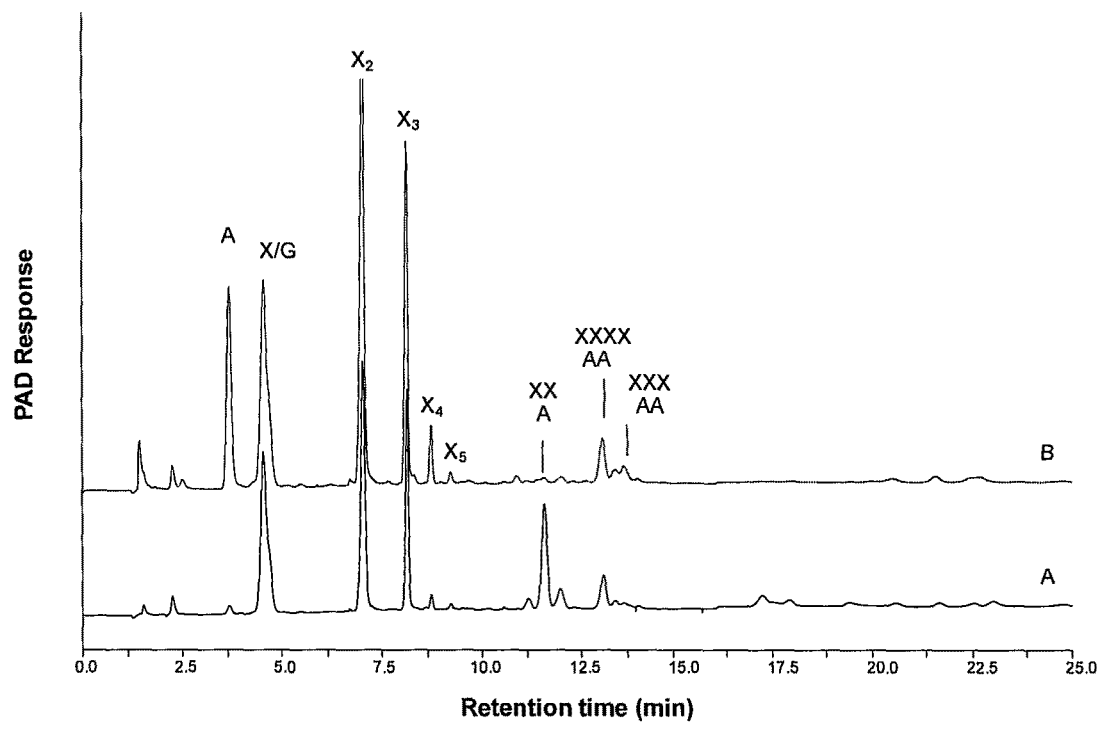
FIG. 5 shows HPAEC spectra of wheat arabinoxylan oligosaccharides before (A) and after digestion with the arabinofuranosidase Abf5 (B). The experiments were performed at pH 5.0, 30° C. during 20 hours. X indicates xylose, A indicates arabinose and G indicates glucose.

The pH optimum of Abf3 was found to be pH 5. At pH 3 and 4 the enzyme is still very active. From pH 6 onwards, the activity decreased. At pH 8 only 20% of the activity remained. Abf3 was found to release arabinose from wheat arabinoxylan oligosaccharides. The enzyme was able to remove arabinose residues, which were monosubstituted to the xylose backbone. Arabinose residues linked to both O2 and O3 position of the xylose residue were released. Abf3 was also found to release glucose and cellobiose from cellodextrins with a degree of polymerization of ≥4. It had no activity towards cellotriose, suggesting the enzyme possesses β-glucosidase activity besides α-arabinofuranosidase activity Abf5 was found to release arabinose when incubated with wheat arabinoxylan oligosaccharides (FIG. 5B). The enzyme was only able to remove arabinose residues, which were mono substituted to the xylose backbone, and not the doubly substituted arabinoxylan oligosaccharides. The arabinose residues on the mono substituted oligosaccharides where all linked to $O_3$ position of the xylose residue.

Example 8

The following example illustrates the assay used to measure β-xylosidase activity. This assay measured the release of p-nitrophenol by the action of β-xylosidase on p-nitrophenyl β-D-xylopyranoside (PNPX). One β-xylosidase unit of activity is the amount of enzyme that liberates 1 micromole of p-nitrophenol in one minute.

Reagents

Sodium acetate buffer (0.1 M, pH 5.0) was prepared as follows. 8.2 g of anhydrous sodium acetate or 13.6 g of sodium acetate*3H$_2$O was dissolved in distilled water to a final volume of 1000 mL (Solution A). In a separate flask, 6.0 g (5.72 mL) of glacial acetic acid was mixed with distilled water to make the total volume of 1000 mL (Solution B). The final 0.1 M sodium acetate buffer, pH 5.0, was prepared by mixing Solution A with Solution B until the pH of the resulting solution was equal to 5.0.

PNPX from Extrasynthese (France, cat. #4244) was used as the assay substrate. 16.5 mg of PNPX was dissolved in 5 mL of distilled water and 5 mL 0.1 M sodium acetate buffer using magnetic stirrer to obtain 2 mM stock solution. The solution was stable for 2 days on storage at 4° C.

The stop reagent (0.25 M sodium carbonate solution) was prepared as follows. 26.5 g of anhydrous sodium carbonate was dissolved in 800 mL of distilled water, and the solution volume was adjusted to 1000 mL. This reagent was used to terminate the enzymatic reaction.

Using the above reagents, the assay was performed as detailed below.

Enzyme Sample 0.10 mL of 2 mM PNPX stock solution was mixed with 0.01 mL of the enzyme sample and incubated at 50° C. for 20 minutes. After exactly 30 minutes of incubation, 0.1 mL of 0.25 M sodium carbonate solution was added and then the absorbance at 405 nm (05) was measured in microtiter plates as $A_S$ (enzyme sample).

Substrate Blank 0.10 mL of 2 mM PNPX stock solution was mixed with 0.01 mL of 0.05 M sodium acetate buffer, pH 5.0. 0.1 mL of 0.25 M sodium carbonate solution was added and the absorbance at 405 nm ($A_{405}$) was measured in microtiter plates as $A_{SB}$ (substrate blank).

Calculation of Activity

Activity was calculated as follows:

$$\text{Activity (IU/ml)} = \frac{\Delta A_{405} * DF * 21 * 1.33}{13.700 * 20}$$

where $\Delta A_{405} = A_S$ (enzyme sample)$-A_{SB}$ (substrate blank), DF is the enzyme dilution factor, 21 is the dilution of 10 μl enzyme solution in 210 μl reaction volume, 1.33 is the conversion factor of microtiter plates to cuvettes, 13.700 is the extinction coefficient 13700 $M^{-1}$ $cm^{-1}$ of p-nitrophenol released corrected for mol/L to μmol/mL, and 20 minutes is the reaction time.

Results

β-xylosidase activity of Bxl1 was found to be 0.94 IU/mL ($\Delta A_{405}=0.92$, DF=10) of enzyme produced in 1.5 L fermentations.

Example 9

The following example illustrates the assay used to measure β-galactosidase activity. This assay measures the action of β-galactosidase on 5-Bromo-4-chloro-3-indolyl β-D-galactoside (X-Gal) to yield galactose and 5-bromo-4-chloro-3-hydroxyindole. 5-bromo-4-chloro-3-hydroxyindole was oxidized into 5,5'-dibromo-4,4'-dichloro-indigo, which is an insoluble blue product.

Reagents

Sodium acetate buffer (0.05 M, pH 5.0) was prepared as follows. 4.1 g of anhydrous sodium acetate or 6.8 g of sodium acetate*3H$_2$O was dissolved in distilled water to a final volume of 1000 mL (Solution A). In a separate flask, 3.0 g (2.86 mL) of glacial acetic acid was mixed with distilled water to total volume of 1000 mL (Solution B). The final 0.05 M sodium acetate buffer, pH 5.0, was prepared by mixing Solution A with Solution B until the pH of the resulting solution was 5.0.

X-Gal from Fermentas (St. Leon Rot, Germany) was used as the assay substrate. 1.0 mg of X-Gal was dissolved in 10 mL 0.05 M sodium acetate buffer using magnetic stirrer.

Using the above reagents, the assay was performed as detailed below.

Enzyme Sample 0.10 mL of 0.1 mg/mL X-Gal stock solution was mixed with 0.01 mL of the enzyme sample and incubated at 37° C. for 3 hours. After 3 hours of incubation, the absorbance at 590 nm ($A_{590}$) was measured in microtiter plates as $A_S$ (enzyme sample).

Substrate Blank 0.10 mL of 0.1 mg/mL X-Gal stock solution was mixed with 0.01 mL of 0.05 M sodium acetate buffer, pH 5.0 and incubated at 37° C. for 3 hours. After 3 hours of incubation, the absorbance at 590 nm ($A_{590}$) was measured in microtiter plates as $A_{SB}$ (substrate blank).

Calculation of Activity

Activity was calculated as follows $$\text{Activity(IU/ml)} = \Delta A_{590} * DF$$

where $\Delta A_{590} = A_S$ (enzyme sample)$-A_{SB}$ (substrate blank) and DF is the enzyme dilution factor.

Results

The $\Delta A_{590}$ of Bga2 was found to be 0.15 with a DF of 1 for enzyme produced in microtiter plate cultures. Bga2 was found to possess β-galactosidase activity, since it was active towards X-Gal.

Example 10

The following example illustrates the assay used to measure acetyl esterase activity. This assay measured the release of p-nitrophenol by the action of acetyl esterase on p-nitrophenyl acetate (PNPAc). One acetyl esterase unit of activity is the amount of enzyme that liberates 1 micromole of p-nitrophenol in one minute at 37° C. and pH 5.

Reagents

Sodium acetate buffer (0.05 M, pH 5.0) was prepared as follows. 4.1 g of anhydrous sodium acetate or 6.8 g of sodium acetate*$3H_2O$ was dissolved in distilled water to a final volume of 1000 mL (Solution A). In a separate flask, 3.0 g (2.86 mL) of glacial acetic acid was mixed with distilled water to make the total volume of 1000 mL (Solution B). The final 0.05 M sodium acetate buffer, pH 5.0, was prepared by mixing Solution A with Solution B until the pH of the resulting solution was 5.0.

PNPAc from Fluka (Switzerland, cat. #46021) was used as the assay substrate. 3.6 mg of PNPAc was dissolved in 10 mL of 0.05 M sodium acetate buffer using magnetic stirrer to obtain 2 mM stock solution. The solution was stable for 2 days on storage at 4° C.

The stop reagent (0.25 M Tris-HCl, pH 8.8) was prepared as follows. 30.29 g of Tris was dissolved in 900 mL of distilled water (Solution A). The final 0.25 M Tris-HCl pH 8.5 was prepared by mixing solution A with 37% HCl until the pH of the resulting solution reached 8.8. The solution volume was adjusted to 1000 mL. This reagent was used to terminate the enzymatic reaction.

Using the above reagents, the assay was performed as detailed below.

Enzyme Sample 0.10 mL of 2 mM PNPAc stock solution was mixed with 0.01 mL of the enzyme sample and incubated at 37° C. for 10 minutes. After exactly 10 minutes of incubation, 0.1 mL of 0.25 M Tris-HCl solution was added and the absorbance at 405 nm ($A_{405}$) was measured in microtiter plates as $A_S$ (enzyme sample).

Substrate Blank 0.10 mL of 2 mM PNPAc stock solution was mixed with 0.01 mL of 0.05 M sodium acetate buffer, pH 5.0. 0.1 mL of 0.25 M Tris-HCl solution was added and the absorbance at 405 nm ($A_{405}$) was measured microtiter plates as $A_{SB}$ (substrate blank).

Calculation of Activity

Activity was calculated as follows:

$$\text{Activity (IU/ml)} = \frac{\Delta A_{405} * DF * 21 * 1.33}{13.700 * 10}$$

where $\Delta A_{405} = A_S$ (enzyme sample)$-A_{SB}$ (substrate blank), DF is the enzyme dilution factor, 21 is the dilution of 10 μt enzyme solution in 210 μt reaction volume, 1.33 is the conversion factor of microtiter plates to cuvettes, 13.700 is the extinction coefficient 13700 $M^{-1}$ $cm^{-1}$ of p-nitrophenol released corrected for mol/L to μmol/mL, and 10 minutes is the reaction time.

Results

The acetyl esterase activity of Rga1 was found to be 1.71 IU/mL ($\Delta A_{405}$=0.84, DF=10) of enzyme produced in 1.5 L fermentations.

Example 11

The following example illustrates the assay used to measure arabinofuranosidase activity. This assay measured the release of arabinose by the action of the α-arabinofuranosidase on branched arabinan.

Reagents

Sodium acetate buffer (0.05 M, pH 5.0) was prepared as follows. 4.1 g of anhydrous sodium acetate or 6.8 g of sodium acetate*$3H_2O$ was dissolved in distilled water to a final volume of 1000 mL (Solution A). In a separate flask, 3.0 g (2.86 mL) of glacial acetic acid was mixed with distilled water to make the total volume of 1000 mL (Solution B). The final 0.05 M sodium acetate buffer, pH 5.0, was prepared by mixing Solution A with Solution B until the pH of the resulting solution was equal to 5.0.

Linear and branched arabinan was purchased from British Sugar.

The assay was performed as detailed below.

Enzyme Sample

The enzyme sample (40-55 •g total protein) was incubated with 5 mg/mL of linear or branched arabinan in 50 mM sodium acetate buffer at 40° C. during 24 hours. The reaction was stopped by heating the samples at 100° C. for 10 minutes. The samples were centrifuged for 5 minutes at 10,000×g. Degradation of the arabinan was followed by HPAEC analysis.

Substrate Blank

10 μL 50 mM sodium acetate buffer pH 5.0 was incubated with 5 mg/mL linear or branched arabinan in 50 mM sodium acetate buffer at 40° C. during 24 hours. The reaction was stopped by heating the samples at 100° C. for 10 minutes. The samples were centrifuged for 5 minutes at 10,000×g. Degradation of the arabinan was followed by HPAEC analysis.

High Performance Anion Exchange Chromatography

The analysis of the samples was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.3 mL/min was used with the following gradient of sodium acetate in 0.1 M NaOH: 0-40 min, 0-400 mM. Each elution was followed by a washing step of 5 min 1,000 mM sodium acetate in 0.1 M NaOH and an equilibration step of 15 min 0.1 M NaOH.

Results

Abn4 was found to release arabinose when incubated with both linear and branched arabinan. The amount of arabinose released from branched arabinan was about 5 times higher compared to linear arabinan. The enzyme was more active towards branched arabinan than towards linear arabinan and was also active towards pNP-α-L-arabinofuranoside (see example 1).

Abn5 was also found to release arabinose when incubated with linear arabinan. No arabinose was released when incubated with branched arabinan. The enzyme was active towards linear arabinan but not towards branched arabinan.

Example 12

This enzyme illustrates the assay used to determine the ability of a protein to bind chitin.

Assay 30 ml fermentation broth was overnight mixed with 5 g chitin in a 50 mL tube at 4° C. Subsequently a plastic column (6.8×150 mm) was filled with the mixture and it was washed with water overnight at 4° C. The method was repeated with the unbound material and fresh chitin. The unbound material was analyzed by SDS-gel electrophoresis. The bound proteins, including the matrix were heated for 10 minutes at 95° C. in sample buffer and separated by SDS-gel electrophoresis. Specific bands from this gel were analyzed by MS/MS.

Results

The protein CL04750, CL05022, CL06230, and CL09768 were found to bind to chitin.

Example 13

This example illustrates the assay used to determine the ability of a protein to bind lichenan (which is a β(1,3)-β(1,4)-linked glucan).

Assay 30 ml fermentation broth was overnight mixed with 5 g lichenan in a 50 mL tube at 4° C. Subsequently a plastic column (6.8×150 mm) was filled with the mixture and it was washed with water overnight at 4° C. The method was repeated with the unbound material and fresh lichenan. The unbound material was analyzed by SDS-gel electrophoresis. The bound proteins, including the matrix were heated for 10 minutes at 95° C. in sample buffer and separated by SDS-gel electrophoresis. Specific bands from this gel were analyzed by MS/MS.

Results

The protein CL02823 was found to bind to lichenan.

Example 14

This example illustrates the assay used to measure the endo-xylanase activity towards AZO-wheat arabinoxylan. This substrate is insoluble in buffered solutions, but rapidly hydrates to form gel particles which are readily and rapidly hydrolysed by specific endo-xylanases releasing soluble dye-labeled fragments.

Reagents

Sodium acetate buffer (0.2 M, pH 5.0) was prepared as follows. 16.4 g of anhydrous sodium acetate or 27.2 g of sodium acetate*$3H_2O$ was dissolved in distilled water to a final volume of 1000 mL (Solution A). In a separate flask, 12.0 g (11.44 mL) of glacial acetic acid was mixed with distilled water to make the total volume of 1000 mL (Solution B). The final 0.2 M sodium acetate buffer, pH 5.0, was prepared by mixing Solution A with Solution B until the pH of the resulting solution was equal to 5.0.

AZO-wheat arabinoxylan (AZO-WAX) from Megazyme (Bray, Ireland, Cat. # I-AWAXP) was used as the assay substrate. 1 g of AZO-WAX was suspended in 3 mL ethanol and adjusted to 100 mL with 0.2 M sodium acetate buffer pH 5.0 using magnetic stirrer.

96% Ethanol was used to terminate the enzymatic reaction.

Using the above reagents, the assay was performed as detailed below.

Enzyme Sample 0.2 mL of 10 mg/ml AZO-WAX stock solution was preheated at 40° C. for 10 minutes. This preheated stock solution was mixed with 0.2 mL of the enzyme sample (preheated at 40° C. for 10 min) and incubated at 40° C. for 10 minutes. After exactly 10 minutes of incubation, 1.0 mL of 96% ethanol was added and then the absorbance at 590 nm ($A_{590}$) was measured as $A_S$ (enzyme sample).

Substrate Blank 0.2 mL of 10 mg/ml AZO-WAX stock solution was preheated at 40° C. for 10 minutes. This preheated stock solution was mixed with 200 µl of 0.2 M sodium acetate buffer pH 5.0 (preheated at 40° C. for 10 min) and incubated at 40° C. for 10 minutes. After exactly 10 minutes of incubation, 1.0 mL of 96% ethanol was added and then the absorbance at 590 nm ($A_{590}$) was measured as $A_{SB}$ (substrate blank).

Calculation of Activity

Activity was calculated as follows: endo-xylanase activity was determined by reference to a standard curve, produced from an endo-xylanase with known activity towards AZO-WAX.

$$Activity(IU/ml) = \Delta A_{590}/SC*DF$$

where $\Delta A_{590} = A_S$ (enzyme sample) $- A_{SB}$ (substrate blank), SC is the slope of the standard curve and DF is the enzyme dilution factor.

Results

The activity of Xyl7 produced in 1.5 L fermentations was found to be 304 IU/mL ($\Delta A_{590}$=0.03645, DF=1000 and SC=0.12). The enzyme was found to possess endo-xylanase activity.

The activity of Xyl8 produced in 1.5 L fermentations was found to be 426 IU/mL ($\Delta A_{590}$=0.2694, DF=500 and SC=0.316). The enzyme was found to possess endo-xylanase activity.

The activity of Xyl9 produced in 1.5 L fermentations was found to be 955 IU/mL ($\Delta A_{590}$=0.211, DF=1000 and SC=0.221). The enzyme was found to possess endo-xylanase activity.

The activity of Xyl10 produced in 1.5 L fermentations was found to be 6 IU/mL ($\Delta A_{590}$=0.00165, DF=500 and SC=0.13). The endo-xylanase activity was very low compared to the other xylanases, concluding that this enzyme does not possess endo-xylanase activity.

The activity of Xyl11 produced in 1.5 L fermentations was found to be 627 IU/mL ($\Delta A_{590}$=0.6295, DF=295 and SC=0.296). The enzyme was found to possess endo-xylanase activity.

Example 15

This example illustrates the assay used to measure xylanase activity. This assay measured the release of xylose and xylo-oligosaccharides by the action of xylanases on wheat arabinoxylan oligosaccharides (WAX).

Reagents

Sodium acetate buffer (0.05 M, pH 5.0) was prepared as follows. 4.1 g of anhydrous sodium acetate or 6.8 g of sodium acetate*$3H_2O$ was dissolved in distilled water to a final volume of 1000 mL (Solution A). In a separate flask, 3.0 g (2.86 mL) of glacial acetic acid was mixed with distilled water to make the total volume of 1000 mL (Solution B). The final 0.05 M sodium acetate buffer, pH 5.0, was prepared by mixing Solution A with Solution B until the pH of the resulting solution was 5.0.

Wheat arabinoxylan was purchased from Megazyme (Bray Ireland, Cat. # P-WAXYI).

The assay was performed as detailed below.

Enzyme Sample 5.0 mg/mL of substrate was mixed with 0.05 mg (total protein) of the enzyme sample at 37° C. for 1 hour and 24 hours. The reaction was stopped by heating the samples for 10 minutes at 100° C. The release of xylose and arabinoxylan oligosaccharides were analyzed by High Performance Anion Exchange Chromatography.

Substrate Blank 5.0 mg/mL of substrate was mixed with 10 µl of 0.05 M sodium acetate buffer pH 5.0 at 37° C. for 1 hour and 24 hours. The reaction was stopped by heating the samples for 10 minutes at 100° C. The release of xylose and arabinoxylan oligosaccharides were analyzed by High Performance Anion Exchange Chromatography.

High Performance Anion Exchange Chromatography

The analysis was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.3 mL/min was used with the following gradient of sodium acetate in 0.1 M NaOH: 0-50 min, 0-500 mM. Each elution was followed by a washing step of 5 min 1,000 mM sodium acetate in 0.1 M NaOH and an equilibration step of 15 min 0.1 M NaOH.

Results

Figure 6:
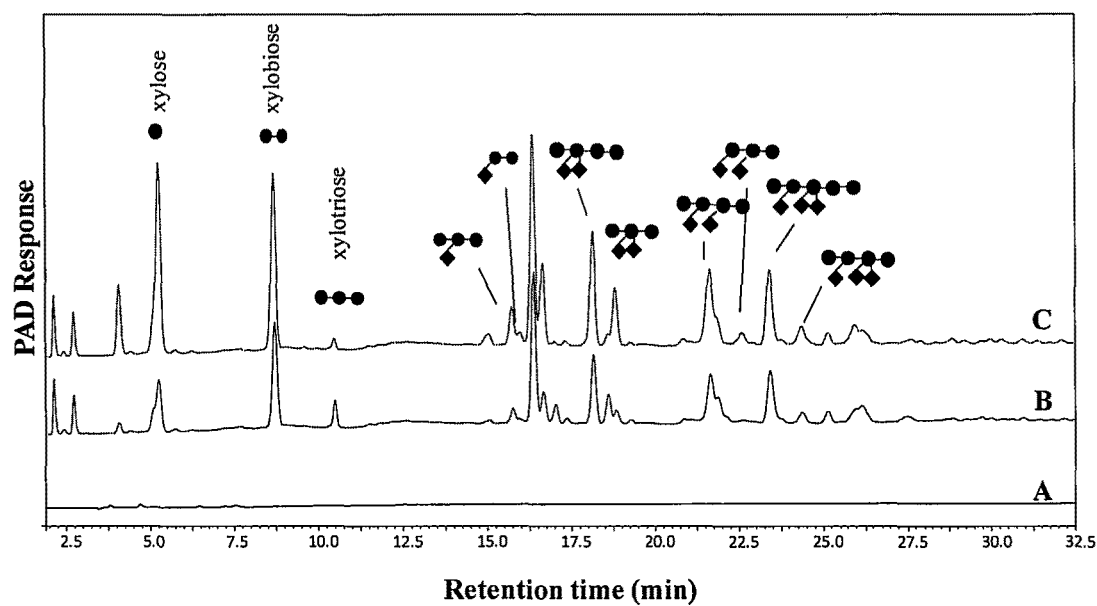
FIG. 6 shows HPAEC spectra of wheat arabinoxylan before (A), after 1 hour of digestion with the xylanase Xyl7 (B), and 24 hours of digestion with the xylanase Xyl7 (C). The experiments were performed at pH 5.0 and 37° C. ● indicates xylose and ♦ indicates arabinose.

Xyl7 was found to release different types of arabinoxylan oligosaccharides and xylose after 1 hour of incubation, as indicated in FIG. 6B. The chromatogram showed the same pattern as a known family GH11 enzyme from *Aspergillus niger* (enzyme collection Laboratory of Food Chemistry, Wageningen University, The Netherlands). After 24 hours of incubation, the amount of xylose and xylobiose had increased. The types of different oligosaccharides formed did not change during the incubation time (FIG. 6C). These results indicated that the enzyme possesses endo-xylanase activity which is similar to family GH11 enzymes.

Xyl10 was found to release mainly xylose and a small amount of xylobiose after 1 hour of incubation. After 24 hours of incubation the amount of both xylose and xylobiose had increased, while no other oligosaccharides were formed. Combining these results with the low activity towards AZO-WAX (see example 14), it was concluded that this xylanase possesses exo-xylanase activity.

Example 16

This example illustrates the assay used to determine the ability of a protein to bind xylan.

Assay 30 ml fermentation broth was overnight mixed with 5 g xylan in a 50 mL tube at 4° C. Subsequently a plastic column (6.8×150 mm) was filled with the mixture and it was washed with water overnight at 4° C. The method was repeated with the unbound material and fresh xylan. The unbound material was analyzed by SDS-gel electrophoresis. The bound proteins, including the matrix, were heated for 10 minutes at 95° C. in sample buffer and separated by SDS-gel electrophoresis. Specific bands from this gel were analyzed by MS/MS.

Results

The protein Xyl8 was found to bind to xylan, indicating the presence of a carbohydrate binding module.

Example 17

The following example illustrates the assay used to measure polygalacturonase activity. This assay measured the amount of reducing sugars released from polygalacturonic acid (PGA) by the action of a polygalacturonase. One unit of activity was defined as 1 µmole of reducing sugars liberated per minute under the specified reaction conditions.

Reagents

Sodium acetate buffer (0.2 M, pH 5.0) was prepared as follows. 16.4 g of anhydrous sodium acetate or 27.2 g of sodium acetate*$3H_2O$ was dissolved in distilled water to a final volume of 1000 mL (Solution A). In a separate flask, 12.0 g (11.44 mL) of glacial acetic acid was mixed with distilled water to make the total volume of 1000 mL (Solution B). The final 0.2 M sodium acetate buffer, pH 5.0, was prepared by mixing Solution A with Solution B until the pH of the resulting solution was equal to 5.0.

Polygalacturonic acid (PGA) was purchased from Sigma (St. Louis, USA).

Reagent A: 10 g of p-Hydroxy benzoic acid hydrazide (PAHBAH) was suspended in 60 mL water. 10 mL of concentrated hydrochloric acid was added and the volume is adjusted to 200 ml. Reagent B: 24.9 g of trisodium citrate was dissolved in 500 ml of water. 2.2 g of calcium chloride and 40 g sodium hydroxide were added. The volume was adjusted to 2 L with water. Both reagents were stored at room temperature. Working Reagent: 10 ml of Reagent A was added to 90 ml of Reagent B. This solution was prepared freshly every day, and was stored on ice between uses.

Using the above reagents, the assay was performed as detailed below.

Enzyme Sample

50 µL of PGA (10.0 mg/mL in 0.2 M sodium acetate buffer pH 5.0) was mixed with 30 µL 0.2 M sodium acetate buffer pH 5.0 and 20 µL of the enzyme sample and incubated at 40° C. for 75 minutes. To 25 µL of this reaction mixture, 125 µL of working solution was added. The samples were heated for 5 minutes at 99° C. After cooling down, the samples were analyzed by measuring the absorbance at 410 nm ($A_{410}$) as $A_S$ (enzyme sample).

Substrate Blank

50 µL of PGA (10.0 mg/mL in 0.2 M sodium acetate buffer pH 5.0) was mixed with 50 µL 0.2 M sodium acetate buffer pH 5.0 and incubated at 40° C. for 75 minutes. To 25 µL of this reaction mixture, 125 µL of working solution was added. The samples were heated for 5 minutes at 99° C. After cooling down, the samples were analyzed by measuring the absorbance at 410 nm ($A_{410}$) as $A_{SB}$ (substrate blank sample).

Calculation of Activity

Activity was calculated as follows:

$$\text{Activity(IU/ml)} = \Delta A_{410}/SC*DF$$

where $\Delta A_{410} = A_S$ (enzyme sample)$-A_{SB}$ (substrate blank), SC is the slope of the standard curve and DF is the enzyme dilution factor.

Results

The $\Delta A_{410}$ of Pgx1 was 1.47 with a DF of 400 for enzyme produced in 1.5 L fermentation. Thus, Pgx1 was found to be active towards polygalacturonic acid, indicating that it is a polygalacturonase.

Example 18

The following example illustrates the assay used to measure β-galactosidase activity. This assay measured the release of p-nitrophenol by the action of β-galactosidase on p-nitrophenyl-β-D-galactopyranoside (PNPGa). One β-galactosidase unit of activity is the amount of enzyme that liberates 1 micromole of p-nitrophenol in one minute.

Reagents

McIlvain buffer (pH 4.0) was prepared as follows. 21.01 g of citric acid monohydrate ($C_6H_8O_7 \cdot H_2O$) was dissolved in Millipore water so that the final volume of the solution to be 1000 mL (Solution A). In a separate flask, 53.62 g of $Na_2HPO_4 \cdot 7H_2O$ was dissolved in Millipore water to make the total volume of 1000 mL (Solution B). The final McIlvain buffer, pH 4.0, was prepared by mixing 614.5 mL Solution A with 385.5 mL Solution B. The pH of the resulting solution was equal to 7.0

PNPGa from Fluka (Switzerland, cat. #46021) was used as the assay substrate. 2.7 mg of PNPGa was dissolved in 10 mL of McIlvain buffer using magnetic stirrer to obtain 1.5 mM stock solution. The solution was stable for 2 days on storage at 4° C.

The stop reagent (0.25 M sodium carbonate solution) was prepared as follows. 26.5 g of anhydrous sodium carbonate was dissolved in 800 mL of distilled water, and the solution volume was adjusted to 1000 mL. This reagent was used to terminate the enzymatic reaction.

Using the above reagents, the assay was performed as detailed below.

Enzyme Sample 0.25 mL of 1.5 mM PNPGa stock solution was mixed with 0.05 mL of the enzyme sample and 0.2 mL buffer and incubated at 37° C. for 10 minutes. After exactly 10 minutes of incubation, 0.5 mL of 1 M $Na_2CO_3$ solution was added and then the absorbance at 410 nm ($A_{410}$) was measured in microtiter plates as $A_S$ (enzyme sample).

Substrate Blank 0.25 mL of 1.5 mM PNPGa stock solution was mixed with 0.25 mL of buffer and incubated at 37° C. for 10 minutes. After exactly 10 minutes of incubation, 0.5 mL of 1 M $Na_2CO_3$ solution was added and then the absorbance at 410 nm ($A_{410}$) was measured in microtiter plates as $A_{SB}$ (substrate blank sample).

Calculation of Activity

Activity was calculated as follows:

$$\text{Activity (IU/ml)} = \frac{\Delta A_{405} * DF * 20 * 1.33}{13.700 * 10}$$

where $\Delta A_{410} = A_S$ (enzyme sample)$-A_{SB}$ (substrate blank), DF is the enzyme dilution factor, 20 is the dilution of 50 µl enzyme solution in 1000 µl reaction volume, 1.33 is the conversion factor of microtiter plates to cuvettes, 13.700 is the extinction coefficient 13700 $M^{-1}$ $cm^{-1}$ of p-nitrophenol released corrected for mol/L to µmol/mL, and 10 minutes is the reaction time.

Determination of pH and Temperature Optimum

The pH optimum of Bga2 was determined by analyzing its activity towards PNPGa at pH 3, 4, 5, 6, 7, and 8. The substrate was dissolved in McIlvain's buffer at the pH of analysis. The incubation was done at 37° C. The temperature optimum of the enzyme was determined by analyzing its activity towards PNPGa at 30° C., 40° C., 50° C., 60° C., 70° C., and 80° C. The substrate was dissolved in McIlvain's buffer at the pH optimum obtained from previous experiment.

Results

The β-galactosidase activity of Bga2 was found to be 449 IU/mg of purified protein. The optimum temperature was found to be 60° C. and the optimum pH was 5-6.

Example 19

This example illustrates the assay used to measure the optimal pH and optimal temperature of acetyl xylan esterases. This assay measured the release of acetate by the action of acetyl xylan esterase on acetylated xylooligosaccharides from *Eucalyptus* wood.

Reagents

Acetylated, 4-O-MeGlcA substituted xylo-oligosaccharides with 2-10 xylose residues from *Eucalyptus globulus* wood (EW-XOS), *Eucalyptus globulus* wood alcohol insoluble solids (AIS) and *Eucalyptus globulus* xylan polymer were obtained from Kabel et al. 2002.

Using the above reagents, the assay was performed as detailed below.

Enzyme Sample 5 mL of substrate solution, containing 1 mg EW-XOS in Millipore water was mixed with 0.5% (w/w) enzyme/substrate ratio and incubated at the desired temperature and pH. The pH of the substrate was adjusted to the desired pH with 1 mM NaOH. The same NaOH solution was used to adjust the pH by pH STAT (719S and 702SM Titrino, Metrohm) to keep it constant during reaction. The amount of NaOH solution added was recorded automatically every 10 seconds. The added volume of NaOH solution was proportional to the release of acetate by the acetyl xylan esterase.

Calculation of Activity

The amount of acetate released was plotted in time. The slope of this curve at the initial stage of the reaction represents the initial activity of the enzyme.

Determination of pH and Temperature Optimum

The pH optimum was determined by analyzing the enzyme activity towards EW-XOS at pH 4.0, 4.5, 5.0, 5.5, 6.0, 6.5, 7.0 and 7.5 using the above described method. The incubation was done at 35° C. The temperature optimum of the enzyme was determined by analyzing its activity towards EW-XOS at 35° C., 40° C., 45° C., 50° C., and 60° C., using the above described method. The incubation was done at the pH optimum obtained from previous experiment.

Results

The optimum temperature for the enzyme Axe2 was found to be 40° C. and the pH optimum was found to be 7.0. The optimum temperature for the enzyme Axe3 was found to be 40° C. and the pH optimum was found to be 7.0. Both, the specific activity of Axe2 and Axe3 were higher towards oligosaccharides then towards polysaccharides. However, the specific activity of Axe3 towards oligosaccharides was lower then the one of Axe2. At the end of the saccharification period the same amount of acetic acid was released for both enzymes. This results showed that the Axe2 releases the acetic acid faster then Axe3, but the total amount of acetic acid released was equal for both enzymes.

Example 20

This example illustrates the assay used to measure acetyl xylan esterase activity towards arabinoxylan oligosaccharides from *Eucalyptus* wood. This assay measured the release of acetate by the action of the acetyl xylan esterases on the arabinoxylan oligosaccharides.
Reagents
Phosphate buffer (0.05 M, pH 7.0) was prepared as follows. 13.8 g of $NaH_2PO_4*H_2O$ was dissolved in 1 L of Millipore water. 26.8 g $Na_2HPO_4*7H_2O$ was dissolved in Millipore water. 195 mL, of the $NaH_2PO_4$ solution was mixed with 305 mL of the $Na_2HPO_4$ solution and adjusted to 1000 mL with Millipore water. The pH of the resulting solution was equal to 7.0.
Acetylated, 4-O-MeGlcA substituted xylo-oligosaccharides with 2-10 xylose residues from *Eucalyptus globulus* wood (EW-XOS), *Eucalyptus globulus* wood AIS and *Eucalyptus globulus* xylan polymer were obtained using the method described in Kabel et al. 2002.
Enzyme Sample
5 mL of substrate solution, containing 1 mg EW-XOS in Millipore water was mixed with 0.5% (w/w) enzyme/substrate ratio and incubated at 40° C. and pH 7 for 24 hours. The reaction was stopped by heating the samples for 10 minutes at 100° C. The release of acetic acid and formation of new (arabino)xylan oligosaccharides were analyzed by Matrix-Assisted Laser Desorption/Ionisation Time-Of-Flight Mass Spectrometry and Capillary Electrophoresis.
Substrate Blank
5 mL of substrate solution, containing 1 mg EW-XOS in Millipore water was mixed with buffer to the same volume as the enzyme sample and incubated at 40° C. and pH 7 for 24 hours. The reaction is stopped by heating the samples for 10 minutes at 100° C. The release of acetic acid and formation of new (arabino)xylan oligosaccharides were analyzed by Matrix-Assisted Laser Desorption/Ionisation Time-Of-Flight Mass Spectrometry and Capillary Electrophoresis.
Matrix-Assisted Laser Desorption/Ionisation Time-Of-Flight Mass Spectrometry (MALDI-TOF MS)
For MALDI-TOF MS an Ultraflex workstation (Bruker Daltronics GmbH, Germany) was used with a nitrogen laser at 337 nm. The mass spectrometer was calibrated with a mixture of malto-dextrins (mass range 365-2309). The samples were mixed with a matrix solution (1 μL each). The matrix solution was prepared by dissolving 10 mg of 2,5-dihydroxybenzoic acid in a 1 mL mixture of Millipore water in order to prepare a saturated solution. After thorough mixing, the solution was centrifuged to remove undissolved material. 1 •L of the prepared sample and 1 •L of matrix solution was put on a gold plate and dried with warm air.
Capillary Electrophoresis-Laser Induced Fluorescence Detector (CE-LIF)
Samples containing about 0.4 mg of EW-XOS were substituted with 5 nmol of maltose as an internal standard. The samples were dried using centrifugal vacuum evaporator (Speedvac). 5 mg of APTS labeling dye (Beckman Coulter) was dissolved in 48 •L of 15% acetic acid (Beckman Coulter). The dried samples were mixed with 2 •L of the labeling dye solution and 2 •L of 1 M Sodium Cyanoborohydride (THF, Sigma-Aldrich). The samples were incubated overnight in the dark to allow the labeling reaction to be completed. After overnight incubation, the labeled samples were diluted 100 times with Millipore water before analysis by CE-LIF.

Figure 7:
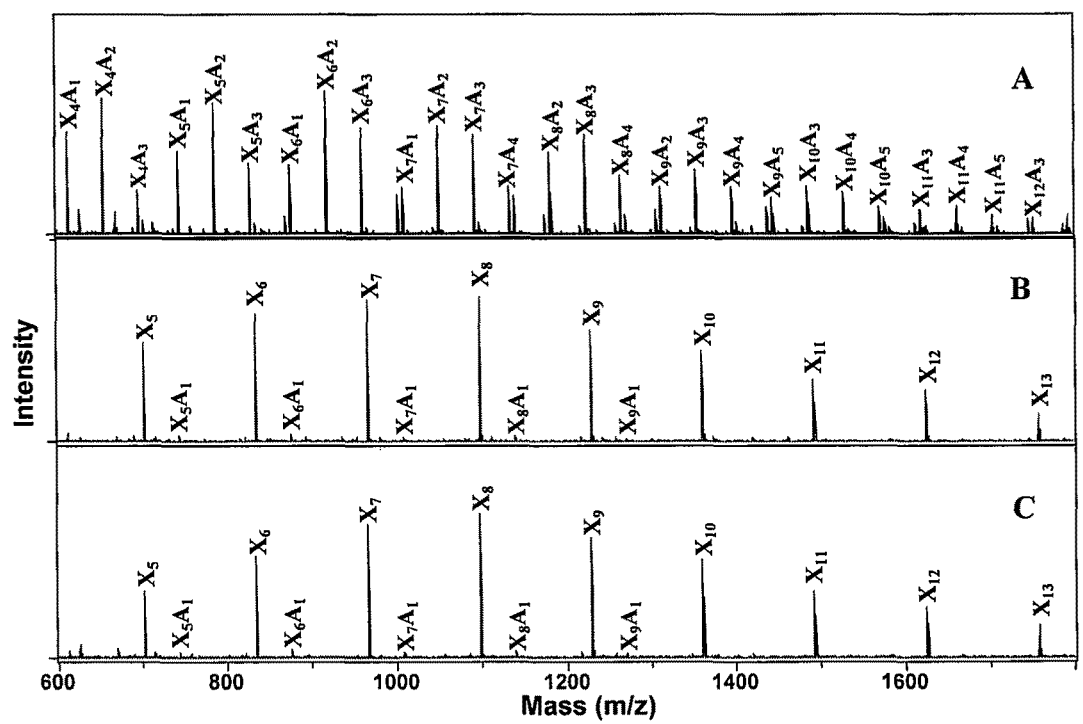
FIG. 7 shows MALDI-TOF MS mass spectra of the hydrolysis products of acetylated EW-XOS (A) after digestion by Axe2 (B) and Axe3 (C). The experiment was performed at pH 7.0 and 40° C. during 24 h of incubation.
Figure 8:
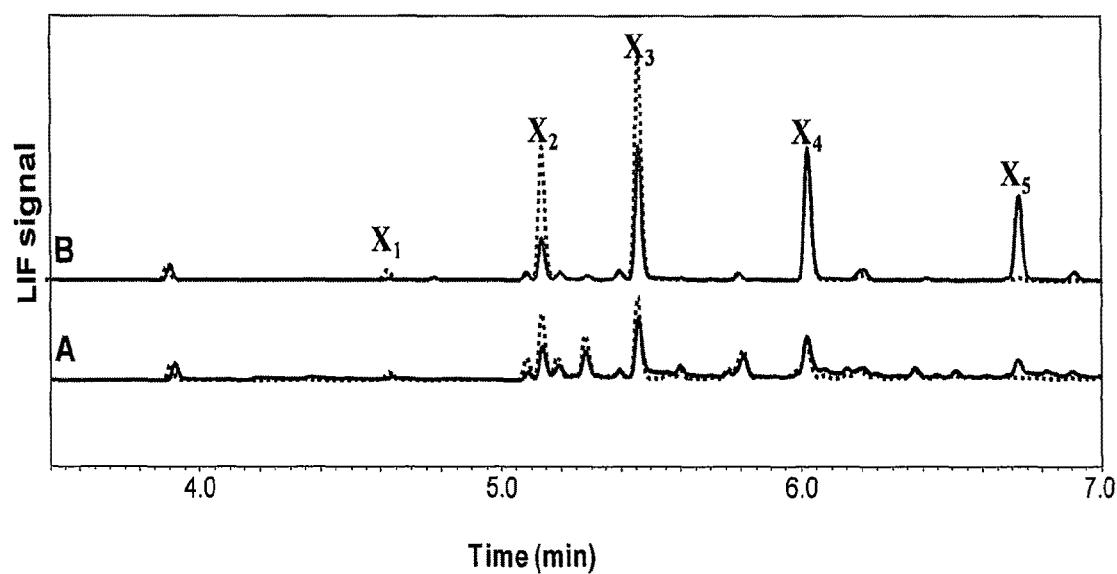
FIG. 8 shows CE electropherograms of the EW-XOS (A) and EW-XOS digested with Axe2 (B). The red dotted line shows the results obtained when the samples were subsequently incubated with a GH10 xylanase from *Aspergillus awamori* (enzyme collection Laboratory of Food Chemistry, Wageningen University, The Netherlands). The experiments were performed at pH 7.0, 40° C. for 5 hours. X indicates xylose.

CE-LIF was performed using ProteomeLab PA800 Protein Characterization System (Beckman Coulter), controlled by 32 Karat Software. The capillary column used was polyvinyl alcohol coated capillary (N—CHO capillary, Beckman Coulter), having 50 •m ID, 50.2 cm length and 40 cm to detector window. 25 mM sodium acetate buffer pH 4.75 containing 0.4% polyethyleneoxide (Carbohydrate separation buffer, Beckman Coulter) was used as running buffer. The sample (ca. 3.5 nL) was injected to the capillary by a pressure of 0.5 psi for 3 seconds. The separation was done for 20 minutes at 30 kV separating voltage, with reversed polarity. During analysis, the samples were stored at 10° C. The labeled EW-XOS were detected using LIF detector at 488 nm excitation and 520 nm emission wavelengths.
Results
The acetyl xylan esterases Axe2 and Axe3 were found to release almost all acetyl groups from wheat arabinoxylan oligosaccharides after 24 hours, except for one ester linkage per oligomer (as indicated in FIG. 7). It was predicted that the remaining acetyl group was located at a terminal xylose residue. To determine the location of the remaining acetyl group, Capillary Electrophoresis (CE) was performed. With help of CE acetylated EW-XOS can be separated based on the mass and the position of acetyl group. In order to determine the location of the remaining acetyl group, the APTS-labelled Axe hydrolysis product was subsequently digested with a known GH10 endoxylanase from *Aspergillus awamori* (enzyme collection Laboratory of Food Chemistry, Wageningen University, The Netherlands). Since the xylanase will cleave xylobiose from the reducing end, the amount of acetylated xylobiose will increase if the remaining acetyl ester was near or on the xylose residue at the reducing end. On the contrary, if the acetyl ester was on or near the xylose residue at the non-reducing end, only the non-acetylated xylobiose will increase (only the APTS labelled reducing ends are visible with CE-LIF). The electropherogram of samples after 5 h digestion by Axe2 (as indicated in FIG. 8B) as well as by Axe3 (data not shown), showed that after digestion by xylanase1, there was an increase in the non-acetylated xylobiose and but increase in the acetylated xylobiose peaks, which shows that the resistant acetyl ester was found to be located near the non-reducing end of the oligosaccharide. This results indicate that the esterases are able to cleave all acetyl ester linkages as long as they are not close to the non-reducing end.

Example 21

This example illustrates the assay used to measure β-glucosidase activity. This assay measured the release of p-nitrophenol by the action of β-glucosidase on p-nitrophenyl β-D-glucopyranoside (PNPG). One β-glucosidase unit of activity is the amount of enzyme that liberates 1 micromole of p-nitrophenol in one minute.
Reagents
Sodium acetate buffer (0.2 M, pH 5.0) was prepared as follows. 16.4 g of anhydrous sodium acetate or 27.2 g of sodium acetate*$3H_2O$ was dissolved in distilled water to a final volume of 1000 mL (Solution A). In a separate flask, 12 g (11.44 mL) of glacial acetic acid was mixed with distilled water to make the total volume of 1000 mL (Solution B). The final 0.1 M sodium acetate buffer, pH 5.0, was prepared by mixing Solution A with Solution B until the pH of the resulting solution was equal to 5.0.
PNPG from Sigma (St. Louis, USA) was used as the assay substrate. 20 mg of PNPG was dissolved in 5 mL of sodium acetate buffer using magnetic stirrer. The solution was stable for 2 days on storage at 4° C.

The stop reagent (0.25 M Tris-HCl, pH 8.8) was prepared as follows. 30.29 g of Tris was dissolved in 900 mL of distilled water (Solution A). The final 0.25 M Tris-HCl pH 8.5 was prepared by mixing solution A with 37% HCl until the pH of the resulting solution was equal to 8.8. The solution volume was adjusted to 1000 mL. This reagent was used to terminate the enzymatic reaction.

Using the above reagents, the assay was performed as detailed below.

Enzyme Sample 0.025 mL of PNPG stock solution was mixed with 1 µL of the enzyme sample, 0.075 mL buffer and 0.099 mL Millipore water and incubated at 37° C. for 4 minutes. Every minute during 4 minutes a 0.04 mL sample was taken and added to 0.06 mL stop reagent. The absorbance at 410 nm ($A_{410}$) was measured in microtiter plates as $A_S$ (enzyme sample).

Substrate Blank 0.025 mL of PNPG stock solution was mixed with 0.075 mL buffer and 0.1 mL Millipore water and incubated at 37° C. for 4 minutes. Every minute during 4 minutes a 0.04 mL sample was taken and added to 0.06 mL stop reagent. The absorbance at 410 nm ($A_{410}$) was measured in microtiter plates as $A_{SB}$ (substrate blank sample).

Calculation of Activity

The $A_{410}$ values were plotted against time in minutes (X-axis). The slope of the graph was calculated (dA). Enzyme activity was calculated by using the following formula:

$$\text{Specific activity} = \frac{\partial A * V_a * d}{\varepsilon * l * [\text{protein}] * V_p}$$

dA=slope in A/min

Va=reaction volume in l (0.0002 l)

d=dilution factor of assay mix after adding stop reagent (2.5)

•=extinction coefficient (0.0137 $\mu M^{-1}$ $cm^{-1}$)

l=length of cell (0.3 cm)

[protein]=protein stock concentration in mg/ml

Vp=volume of protein stock added to assay (0.001 ml)

Results

The β-glucosidase activity of Bxl2 was found to be 322.6 IU/mL of enzyme produced in 1.5 L fermentations. The β-glucosidase activity of Abf5 was found to be 36.6 IU/mL of enzyme produced in 1.5 L fermentations.

Example 22

This example illustrates the assay used to measure β-xylosidase activity. This assay measured the release of xylose by the action of β-xylosidase on xylobiose.

Reagents

Sodium acetate buffer (0.05 M, pH 5.0) was prepared as follows. 4.1 g of anhydrous sodium acetate or 6.8 g of sodium acetate*3H$_2$O was dissolved in distilled water to a final volume of 1000 mL (Solution A). In a separate flask, 3.0 g (2.86 mL) of glacial acetic acid was mixed with distilled water to make the total volume of 1000 mL (Solution B). The final 0.05 M sodium acetate buffer, pH 5.0, was prepared by mixing Solution A with Solution B until the pH of the resulting solution was equal to 5.0.

Xylobiose was purchased from Megazyme (Bray Ireland, Cat. # P-WAXYI). 25 mg was dissolved in 5 mL sodium acetate buffer pH 5.0.

The assay was performed as detailed below.

Enzyme Sample 0.1 mL of 5.0 mg/mL substrate solution was mixed with 0.02 mL of the enzyme sample at 50° C. and pH 5.0 for 24 hours. The reaction was stopped by heating the samples for 10 minutes at 100° C. The release of xylose and arabinoxylan oligosaccharides were analyzed by High Performance Anion Exchange Chromatography.

Substrate Blank 0.1 mL of 5.0 mg/mL substrate solution was mixed with 0.02 mL of the buffer at 50° C. and pH 5.0 for 24 hours. The reaction was stopped by heating the samples for 10 minutes at 100° C. The release of xylose and arabinoxylan oligosaccharides were analyzed by High Performance Anion Exchange Chromatography.

High Performance Anion Exchange Chromatography

The analysis was performed using a Dionex HPLC system equipped with a Dionex CarboPac PA-1 (2 mm ID×250 mm) column in combination with a CarboPac PA guard column (1 mm ID×25 mm) and a Dionex EDet1 PAD-detector (Dionex Co., Sunnyvale). A flow rate of 0.25 mL/min was used with the following gradient of sodium acetate in 0.1 M NaOH: 0-15 min, 0-150 mM. Each elution was followed by a washing step of 5 min using 1 M sodium acetate in 0.1 M NaOH and an equilibration step of 15 min using 0.1 M NaOH.

Results

Figure 9:
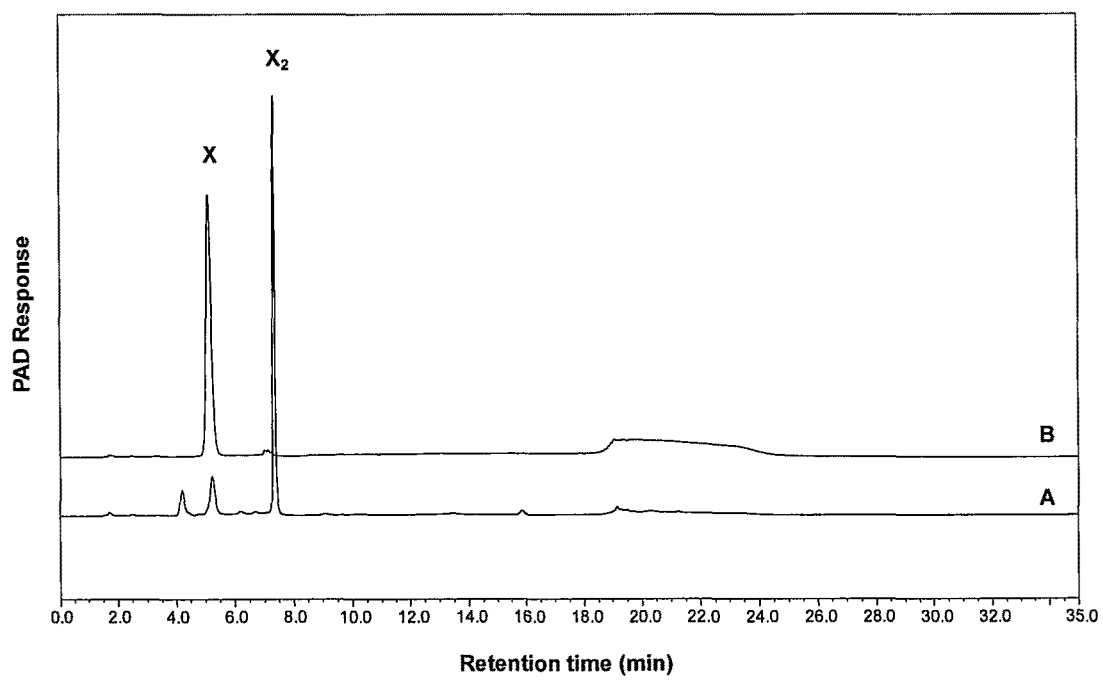
FIG. 9 shows HPAEC spectra of xylobiose after 24 hours of digestion with a negative control (A), and the β-xylosidase Bxl1 (B). The experiments were performed at pH 5.0 and 50° C. X indicates xylose and $X_2$ indicates xylobiose.

Bxl1 (CL06028, seq. 51) was found to release xylose from xylobiose, as indicated in FIG. 9. After 24 hours of incubation the xylobiose was completely degraded into xylose. This result indicated that Bxl1 possesses •-xylosidase activity.

REFERENCES

Gruppen H, Hoffmann R A, Kormelink F J M, Voragen A G J, Kamerling J P, Vliegenthart J F G (1992). Characterization by 1H NMR spectroscopy of enzymically derived oligosaccharides from alkali-extractable wheat-flour arabinoxylan. Carbohydr Res 233:45-64.

Kabel M A, Schols H A, Voragen A G J (2002). Complex xylo-oligosaccharides identified from hydro-thermally treated *Eucalyptus* wood and brewery's spent grain. Carbohdr. Polym. 50: 191-200.

Kormelink F J M, Gruppen H, Viëtor R J, Voragen A G J (1993). Mode of action of the xylan-degrading enzymes from *Aspergillus awamori* on alkali-extractable cereal arabinoxylans. Carbohydr Res 249:355-367.

Sørensen HR, Jørgensen C T, Hansen C H, Jørgensen C I, Pederson S, Meyer A S (2006). A novel GH43 α-L-arabinofuranosidase from *Humicola insolens*: mode of action and synergy with GH51 α-L-arabinofuranosidases on wheat arabinoxylan. Appl Microbiol Biotechnol 73:850-861.

Van den Broek L A M, Lloyd R M, Beldman G, Verdoes J C, McCleary B V, Voragen A G J (2005). Cloning and characterization of arabinoxylan arabinofuranosidase-D3 (AXHd$_3$) from *Bifidobacterium adolescentis* DSM20083. Appl Microbiol Biotechnol 67:641-647.

Van Laere K M J, Beldman G, Voragen A G J (1997). A new arabinofuranohydrolase from *Bifidobacterium adolescentis* able to remove arabinosyl residues from double-substituted xylose units in arabinoxylan. Appl Microbiol Biotechnol 47: 231-235.

U.S. Pat. No. 7,399,627, Transformation System in the Field of Filamentous Fungal Hosts.

U.S. Pat. No. 7,122,330, High-Throughput Screening of Expressed DNA Libraries in Filamentous Fungi.

U.S. Pat. No. 6,573,086. 2003, Transformation System In The Field Of Filamentous Fungal Hosts.

WO 01/79558, High-Throughput Screening of Expressed DNA Libraries in Filamentous Fungi.

PCT WO 01/25468, High Throughput Screening of Expressed DNA Libraries in Filamentous Fungi.

PCT WO 00/20555, Transformation System In The Field Of Filamentous Fungi.

U.S. Pat. No. 6,015,707, Treating cellulosic materials with cellulases from Chrysosporium.

U.S. Pat. No. 5,811,381, Cellulase compositions and methods of use.

While various embodiments of the present invention have been described in detail, it is apparent that modifications and adaptations of those embodiments will occur to those skilled in the art. It is to be expressly understood, however, that such modifications and adaptations are within the scope of the present invention, as set forth in the following exemplary claims.

SEQUENCE LISTING (234 sequences)

SEQ ID NO: 1 - DNA, 3131 bp, Chrysosporium lucknowense
  CDS (64)..(106)
  CDS (167)..(351)
  CDS (403)..(1836)
  CDS (1908)..(2050)
  CDS (2108)..(2199)
  CDS (2274)..(2506)
  CDS (2657)..(3010)
aagttcgatgtgctcgtaggtaggccggcagagtcgaggccaaaccagtctctgcgatccaagatgaggacctcctctcgtttaatcggtgcccttgcggcggcacgtaagtcagagcttagcgtggctcacggtccttcctgtcactaacttgcctgctttgtagtcttgccgtctgcccttgcgcagaacaacgcgccggtaaccttcaccgacccggactcgggcattaccttcaacacgtggggtctcgccgaggattctccccagactaagggcggtttcacttttggtgttgctctgccctctgatgccctcacgacagacgccaaggagttcatcggttacttggtaagccatgtccgagacgcacatgccactcacagctgctaaccgccccagaaatgcgcgaggaacgatgagagcggttggtgcggtgtctccctgggcggccccatgaccaactcgctcctcatcgcggcctggccccacgaggacaccgtctacacctctctccgcttcgccaccggctatgccatgccggatgtctaccagggggacgccgagatcacccaggtctcctcctctgtcaactcgacgcacttcagcctcatcttcaggtgcgagaactgcctgcaatggagtcaaagcggcgccaccggcggtgcctccacctcgaacggcgtgttggtcctcggctgggtccaggcattcgccgaccccggcaacccgacctgccccgaccagatcaccctcgagcagcacgacaacggcatgggtatctggggtgcccagctcaactccgacgccgccagcccgtcctacaccgagtgggccgcccaggccaccaagaccgtcacgggtgactgcggcggtcccaccgagacctctgtcgtcggtgtccccgttccgacgggcgtctcgttcgattacatcgtcgtgggcggcggtgccggtggcatccccgccgccgacaagctcagcgaggccggcaagagtgtgctgctcatcgagaagggctttgcctcgaccgccaacaccggaggcactctcggccccgagtggctcgagggccacgaccttacccgctttgacgtgccgggtctgtgcaaccagatctgggttgactccaaggggatcgcttgcgaggataccgaccagatggctggctgtgtcctcggcggcggtaccgccgtgaatgccggcctgtggttcaagccctactcgctcgactgggactacctcttccctagtggttggaagtacaaagacgtccagccggccatcaaccgcgccctctcgcgcatcccgggcaccgatgctccctcgaccgacggcaagcgctactaccaacagggcttcgacgtcctctccaagggcctggccggcggcggctggacctcggtcacggccaataacgcgccagacaagaagaaccgcaccttctcccatgcccccttcatgttcgccggcggcgagcgcaacggcccgctgggcacctacttccagaccgccaagaagcgcagcaacttcaagctctggctcaacacgtcggtcaagcgcgtcatccgccagggcggccacatcaccggcgtcgaggtcgagccgttccgcgacggcggttaccaaggcatcgtccccgtcaccaaggttacgggccgcgtcatcctctctgccggtacctttggcagtgcaaagatcctgctgaggagcggtatcggtccgaacgatcagctgcaggttgtcgcggcctcggagaaggatggccctaccatgatcagcaactcgtcctggatcaacctgcctgtcggctacaacctggatgaccacctcaacgtaagtttcagaacacaagagttggtcagtgacaaaatactgcgaagcgaaccgctgacccccttcggtagaccgacactgtcatctcccaccccgacgtcgtgttctacgacttctacgaggcgtgggacaatcccatccagtctgacaaggacagctacctcaactcgcgcacgggcatcctcgcccaagccgctcccaacattgggcctatgtgagtccggcgagctcaagcctgtttgtgttcccctaactaaccgaagccaacaaggttctgggaagagatcaagggtgcggacggcattgttcgccagctccagtggactgcccgtgtcgagggcagcctgggtgcccccaacggcagtacgtagattccttttttttttttttttttcatcgactaatccccacgctaactttgtccgtccgctctccagagaccatgaccatgtcgcagtacctcggtcgtggtgccacctcgcgcggccgcatgaccatcaccccgtccctgacaactgtcgtctcggacgtgccctacctcaaggaccccaacgacaaggaggccgtcatccagggcatcatcaacctgcagaacgccctcaagaacgtcgccaacctgacctggctcttccccaactcgaccatcacgccgcgccaatacgttgacagcgtaagtttttgtttacactcctctcccccatccctcccccttcagattgcacttttacttcctctcaaaagagggagaaagagagagcttgcaaggacaattccatactgacataacccttcttcccccttccccctcccctttctccagatggtcgtctccccgagcaaccggcgctccaaccactggatgggcaccaacaagatcggcaccgacgacgggcgcaagggcggctccgccgtcgtcgacctcaacaccaaggtctacggcaccgacaacctcttcgtcatcgacgcctccatcttccccggcgtgcccaccaccaaccccacctcgtacatcgtgacggcgtcggagcacgcctcggcccgcatcctcgccctgcccgacctcacgcccgtccccaagtacgggcagtgcggcggccgcgaatggagcggcagcttcgtctgcgccgacggctccacgtgccagatgcagaacgagtggtactcgcagtgcttgtgagcccacgcgtgggttattaacaagccccgagggccgtgagtttgtgtggtgataggaactctggttttcttgatggggagttgagtttgtgaaattttttacttgtccatacaatcaa

SEQ ID NO: 2 - protein, 828 aa, Chrysosporium lucknowense
MRTSSRLIGALAAALLPSALAQNNAPVTFTDPDSGITFNTWGLAEDSPQTKGGFTFGVALPSDALTTDAKEFIGYLKCARNDESGWCGVSLGGPMTNSLLIAAWPHEDTVYTSLRFATGYAMPDVYQGDAEITQVSSSVNSTHFSLIFRCENCLQWSQSGATGGASTSNGVLVLGWVQAFADPGNPTCPDQITLEQHDNGMGIWGAQLNSDAASPSYTEWAAQATKTVTGDCGGPTETSVVGVPVPTGVSFDYIVVGGGAGGIPAADKLSEAGKSVLLIEKGFASTANTGGTLGPEWLEGHDLTRFDVPGLCNQIWVDSKGIACEDTDQMAGCVLGGGTAVNAGLWFKPYSLDWDYLFPSGWKYKDVQPAINRALSRIPGTDAPSTDGKRYYQQGFDVLSKGLAGGGWTSVTANNAPDKKNRTFSHAPFMFAGGERNGPLGTYFQTAKKRSNFKLWLNTSVKRVIRQGGHITGVEVEPFRDGGYQGIVPVTKVTGRVILSAGTFGSAKILLRSGIGPNDQLQVVAASEKDGPTMISNSSWINLPVGYNLDDHLNTDTVISHPDVVFYDFYEAWDNPIQSDKDSYLNSRTGILAQAAPNIGPMFWEEIKGADGIVRQLQWTARVEGSLGAPNGKTMTMSQYLGRGATSRGRMTITPSLTTVVSDVPYLKDPNDKEAVIQGIINLQNALKNVANLTWLFPNSTITPRQYVDSMVVSPSNRRSNHWMGTNKIGTDDGRKGGSAVVDLNTKVYGTDNLFVIDASIFPGVPTTNPTSYIVTASEHASARILALPDLTPVPKYGQCGGREWSGSFVCADGSTCQMQNEWYSQCL

SEQ ID NO: 3 - DNA, 2484 bp, Chrysosporium lucknowense
atgaggacctcctctcgtttaatcggtgcccttgcggcggcactcttgccgtctgcccttgcgcagaacaacgcgccggtaaccttcaccgacccggactcgggcattaccttcaacacgtggggtctcgccgaggattctccccagactaagggcggtttcacttttggtgttgctctgccctctgatgccctcacgacagacgccaaggagttcatcggttacttgaaatgcgcgaggaacgatgagagcggttggtgcggtgtctccctgggcggccccatgaccaactcgctcctcatcgcggcctggccccacgaggacaccgtctacacctctctccgcttcgccaccggctatgccatgccggatgtctaccagggggacgccgagatcacccaggtctcctcctctgtcaactcgacgcacttcagcctcatcttcaggtgcgagaactgcctgcaatggagtcaaagcggcgccaccggcggtgcctccacctcgaacggcgtgttggtcctcggctgggtccaggcattcgccgaccccggcaacccgacctgccccgaccagatcaccctcgagcagcacgacaacggcatgggtatctggggtgcccagctcaactccgacgccgccagcccgtcctacaccgagtgggccgcccaggccaccaagaccgtcacgggtgactgcggcggtcccaccgagacctctgtcgtcggtgtccccgttccgacgggcgtctcgttcgattacatcgtcgtgggcggcggtgccggtggcatccccgccgccgacaagctcagcgaggccggcaagagtgtgctgctcatcgagaagggctttgcctcgaccgccaacaccggaggcactctcggccccgagtggctcgagggccacgaccttacccgctttgacgtgccgggtctgtgcaaccagatctgggttgactccaaggggatcgcttgcgaggataccgaccagatggctggctgtgtcctcggcggcggtaccgccgtgaatgccggcctgtggttcaagccctactcgctcgactgggactacctcttccctagtggttggaagtacaaagacgtccagccggccatcaaccgcgccctctcgcgcatcccgggcaccgatgctccctcgaccgacggcaagcgctactaccaacagggcttcgacgtcctctccaagggcctggccggcggcggctggacctcggtcacggccaataacgcgccagacaagaagaaccgcaccttctcccatgcccccttcatgttcgccggcggcgagcgcaacggcccgctgggcacctacttccagaccgccaagaagcgcagcaacttcaagctctggctcaacacgtcggtcaagcgcgtcatccgccagggcggccacatcaccggcgtcgaggtcgagccgttccgcgacggcggttaccaaggcatcgtccccgtcaccaaggttacgggccgcgtcatcctctctgccggtacctttggcagtgcaaagatcctgctgaggagcggtatcggtccgaacgatcagctgcaggttgtcgcggcctcggagaaggatggccctaccatgatcagcaactcgtcctggatcaacctgcctgtcggctacaacctggatgaccacctcaacaccgacactgtcatctcccaccccgacgtcgtgttctacgacttctacgaggcgtgggacaatcccatccagtctgacaaggacagctacctcaactcgcgcacgggcatcctcgcccaagccgctcccaacattgggcctatgttctgggaagagatcaagggtgcggacggcattgttcgccagctccagtggactgcccgtgtcgagggcagcctgggtgcccccaacggcaagaccatgaccatgtcgcagtacctcggtcgtggtgccacctcgcgcggccgcatgaccatcaccccgtccctgacaactgtcgtctcggacgtgccctacctcaaggaccccaacgacaaggaggccgtcatccagggcatcatcaacctgcagaacgccctcaagaacgtcgccaacctgacctggctcttccccaactcgaccatcacgccgcgccaatacgttgacagcatggtcgtctccccgagcaaccggcgctccaaccactggatgggcaccaacaagatcggcaccgacgacgggcgcaagggcggctccgccgtcgtcgacctcaacaccaaggtctacggcaccgacaacctcttcgtcatcgacgcctccatcttccccggcgtgcccaccaccaaccccacctcgtacatcgtgacggcgtcggagcacgcctcggcccgcatcctcgccctgcccgacctcacgcccgtccccaagtacgggcagtgcggcggccgcgaatggagcggcagcttcgtctgcgccgacggctccacgtgccagatgcagaacgagtggtactcgcagtgcttg

SEQ ID NO: 4 - DNA, 1919 bp, Chrysosporium lucknowense
  CDS (279)..(340)
  CDS (541)..(718)
  CDS (802)..(915)
  CDS (1028)..(1630)
agcactgttgaagggctgtttggaagtttcttattgtgagagggggctcgagtcacggcaaccaagttcggcgcctggtcatctctggagctgaccacgcctttggccgtcgtcgattccgcgtctcagagccgagttggcgggccccgtgcaggttaaattgtctgcagcgcccggctacctggaactccgagcgattaccagtttcggctcggagcacgaccttcgccaaccccagatcggccacttcaagggaccgaaaccgttgccgtggcccgatgccgtgcaagtcgagcctcctcctcctcctcctctcctccttcttctcctccgaggccaagtccgtgaatacaccaacgacgccgttacgttgctgatacttaagtaaggaagggcgcggcgctcgctgctgctgatgtgaagacgaggagcagacttgaacattggtaaagcagagcactgtttgattgcgctcgtgcactcgccaccatcatccaattaacatacctagcccataattatcggacactggcgttcgagcaccgcccaccgcccaccatgcgtctctgcgatcgctcaccaagatggccgccatggccggcctgcgcggggcgcgtcactgcagctagtgaccaactttggcgacaatccgaccggtctgcagaagtatgtgtacgttccggacaaagttgcggtctcgcccgccatcatcgttgctgtaagtcaacagagcttgattaacattattatgtgtttgagttggattgagtggtgatgaccgctaactttgttgtcgatcagctgcatccctgtggaggatcggctcagggatggtactcgcagacacggctcccgtcgtacgcggaccagcttgggttcatcctcatctacgccggcacgaccaagatgagcaacgtacgcatagtttttttttttttttgcttttttttgcttgctgtattacatagagagttatacccttactaaccataattattttcttcctcgatattttctttgccaacagtgctgggacgtccagaacccggccagcctgacacacggcgggggcgacgccgggggcatcgtcagcatggtcaagtacgcgctgaagcagtacaacggcgacgcgtcgagggtgtacgtcatggggggctcgtcgggggccatgatgaccaacgtgctggcgggctcgtacccggacgtgttcgaggccggcgcggccttctccggggtggcgcacgcgtgcttcctcggggccgactcggcgacgcccttctcgcctaaccagacgtgcgcgcagggccggatccagcggtcggcgcgcgagtggggggacctggtgcgcaactcgttcccggcctacgacggccgccgcccgcgcatgcagatcttccacggcaacgccgacttcctcgtccatcccgagtgcgcccaccaggccctcgcccagtgggccgacgtcctcggcctccagctgacccagaccaacaagggcgtgccctcggccgagtacacccaggaggtctacggcgacggcacccagctgcagggcttctttggcgacggcgtcggccacatcgccccggtcaacgagcccgtcatgctccgcttctttggcctgatgaactagctcgtaccggatgtactgtaccgtaaatgatccatcatttaatagcgaatagtacatagttacataccagtatgtaactgacatgcatgtcaagatcccgacattgtgctccgagtcaaccttggatgggaggtgatgacagcctggaggacgaaagttgatttgaccgtagcatgctgtctgtgctcttttgaggtctgaacgcctcattattaccgcgaacggtgcattgcattatggggggtcgataaacttccaaggggtatagttatacgcgcgtagaaat

SEQ ID NO: 5 - protein, 319 aa, Chrysosporium lucknowense
MPCKSSLLLLLLSSFFSSEANTAHRPPCVSAIAHQDGRHGRPARGASLQLVTNFGDNPTGLQKYVYVPDKVAVSPAIIVALHPCGGSAQGWYSQTRLPSYADQLGFILIYAGTTKMSNCWDVQNPASLTHGGGDAGGIVSMVKYALKQYNGDASRVYVMGGSSGAMMTNVLAGSYPDVFEAGAAFSGVAHACFLGADSATPFSPNQTCAQGRIQRSAREWGDLVRNSFPAYDGRRPRMQIFHGNADFLVHPECAHQALAQWADVLGLQLTQTNKGVPSAEYTQEVYGDGTQLQGFFGDGVGHIAPVNEPVMLRFFGLMN

SEQ ID NO: 6 - DNA, 957 bp, Chrysosporium lucknowense
atgccgtgcaagtcgagcctcctcctcctcctcctctcctccttcttctcctccgaggccaacaccgcccaccgcccaccatgcgtctctgcgatcgctcaccaagatggccgccatggccggcctgcgcggggcgcgtcactgcagctagtgaccaactttggcgacaatccgaccggtctgcagaagtatgtgtacgttccggacaaagttgcggtctcgcccgccatcatcgttgctctgcatccctgtggaggatcggctcagggatggtactcgcagacacggctcccgtcgtacgcggaccagcttgggttcatcctcatctacgccggcacgaccaagatgagcaactgctgggacgtccagaacccggccagcctgacacacggcgggggcgacgccgggggcatcgtcagcatggtcaagtacgcgctgaagcagtacaacggcgacgcgtcgagggtgtacgtcatggggggctcgtcgggggccatgatgaccaacgtgctggcgggctcgtacccggacgtgttcgaggccggcgcggccttctccggggtggcgcacgcgtgcttcctcggggccgactcggcgacgcccttctcgcctaaccagacgtgcgcgcagggccggatccagcggtcggcgcgcgagtggggggacctggtgcgcaactcgttcccggcctacgacggccgccgcccgcgcatgcagatcttccacggcaacgccgacttcctcgtccatcccgagtgcgcccaccaggccctcgcccagtgggccgacgtcctcggcctccagctgacccagaccaacaagggcgtgccctcggccgagtacacccaggaggtctacggcgacggcacccagctgcagggcttctttggcgacggcgtcggccacatcgccccggtcaacgagcccgtcatgctccgcttctttggcctgatgaac

SEQ ID NO: 7 - DNA, 1134 bp, Chrysosporium lucknowense
  CDS (158)..(302)
  CDS (388)..(1031)
acataattagagcagcgtagatattagggggcggcggcgtacaacctagctacctacctacctagttaccttattcttgcttcttctctctgggctcgaatcgggcgcttcgccagccaagagacaaagcagtgccgctaaaagttcttttgacaacatgcgaccgtggtcgactctcctcgccgcggggcttgctgcctcgggggctcacgccactccggtcgaggccgctcggcgggcgacgccaacggtctacctcgccggcgacagcaccatggccaagacgggcaacgggcttatgggtaagtactttgcctggacagaagccggatgcaaaccgccccgttgattgggagcatctggctcacaccctctctccctacctaggctggggcgagtacctcccgaactacatcacgctccccgtagtcaacaaggccatctccgggcggtcggcccgcagctacaccaacgaagggcgcttcgccgagatcgagtcgctggtgcggaccgacgacattgtagtgatcgagtttggccacaacgacggcgggtcgcccaactcggccaacgacaacggccgcagcgactgcccgggcacggccgacgagatttgctactcgggcaagacgggcgagatcgtctacaccttcaaccactacgtcgaggcggcggcgcggagctacatcgccaagggggcccgcgtcatcatcagcagccagacgcccaacaacatgtgggagggcggcacctacaacaacgcgccctcgcgcttcgtcggctacgccgccacggccgccaagaacgtcggcgccggcgccagctttgtcgaccacttccaggccgtcggcgccatgttcctgcgcctcggcaacgcggccaccaacggcctctacccgcaggaccacacccacaccagccccgagggcgccgacttggtcgctcaggccttcgtgcaggccgtgagcctcgatttcaacgggacaacgccgctcaaggagtatctcaagaccccggtgcctcaggtgttctaagctttgccttgtgtttttcttcgtttcgggtcatcagggggaagggggagtcgcaagccagcatctatctgcagttatccgggggaagagatatcaaaaa

SEQ ID NO: 8 - protein, 263 aa, Chrysosporium lucknowense
MRPWSTLLAAGLAASGAHATPVEAARRATPTVYLAGDSTMAKTGNGLMGWGEYLPNYITLPVVNKAISGRSARSYTNEGRFAEIESLVRTDDIVVIEFGHNDGGSPNSANDNGRSDCPGTADEICYSGKTGEIVYTFNHYVEAAARSYIAKGARVIISSQTPNNMWEGGTYNNAPSRFVGYAATAAKNVGAGASFVDHFQAVGAMFLRLGNAATNGLYPQDHTHTSPEGADLVAQAFVQAVSLDFNGTTPLKEYLKTPVPQVF

SEQ ID NO: 9 - DNA, 789 bp, Chrysosporium lucknowense
atgcgaccgtggtcgactctcctcgccgcggggcttgctgcctcgggggctcacgccactccggtcgaggccgctcggcgggcgacgccaacggtctacctcgccggcgacagcaccatggccaagacgggcaacgggcttatgggctggggcgagtacctcccgaactacatcacgctccccgtagtcaacaaggccatctccgggcggtcggcccgcagctacaccaacgaagggcgcttcgccgagatcgagtcgctggtgcggaccgacgacattgtagtgatcgagtttggccacaacgacggcgggtcgcccaactcggccaacgacaacggccgcagcgactgcccgggcacggccgacgagatttgctactcgggcaagacgggcgagatcgtctacaccttcaaccactacgtcgaggcggcggcgcggagctacatcgccaagggggcccgcgtcatcatcagcagccagacgcccaacaacatgtgggagggcggcacctacaacaacgcgccctcgcgcttcgtcggctacgccgccacggccgccaagaacgtcggcgccggcgccagctttgtcgaccacttccaggccgtcggcgccatgttcctgcgcctcggcaacgcggccaccaacggcctctacccgcaggaccacacccacaccagccccgagggcgccgacttggtcgctcaggccttcgtgcaggccgtgagcctcgatttcaacgggacaacgccgctcaaggagtatctcaagaccccggtgcctcaggtgttc

SEQ ID NO: 10 - DNA, 1994 bp, Chrysosporium lucknowense
  CDS (465)..(1910)
aggaccggacgtttgggccctagtcgccttagtcttgcaaaccagcaaaggccaccaacaatcaattcaggtctcggagaagaggctggtctgctcagctcggtccgcctttttccgccaaccgcccgtctcggggcgaaatttgaccgaattaattatctaccgaaagtgaggtggggagtggtaggaggaggctgcactcgaccagccgagagagccccagaaaaaatgcatattctggccctggcgttgcactgtacttttattattggaaagcagtcgaccctaatataccgacattgtcggcatcgtcgtttgcggacgacaaccctattccggcgggatacatattaataattaaacccttatattccttcccgcaatgcggatttccaagatactgtcgtcatgacccgctatcgtggcttcattttgtccaacatttcgatcccgctccccccgccatgattaattcgtctcctttgttggggttggccttggtgctggccaccagtcccctggcgagcgccgacagcaccacaatcatcaacgctggctcaaactggggcacttgggaaggttggggcacgtctctggcatggtgggccaagcagttcggcaaccgcgatgacctggccgatgccttcttcaccttaaagtcgacgacggtgaattcggagacgctgcccgggcttggcttcaacattgtgcgttacaacgcgggcgcgtcgagctggaacgcggtcggagatgagaggatggtcgagtcccccaacatccggcggtcgcgccagatggaggggttctggctggactggcacgacacggacccgacctcatcgagctgggactggaccgtggacgcgaaccagaggtcggcgctccagaaggcgatcgcgcgcggggccaacaggacggagctcttctccaactcgcccatgtggtggatgtgcaagaaccacaacccgtccgggtccagcgacggcagcgagaacatccagtcgtggaacctggagcagcacgccgtctacatggccaacgttgccatgatgtaccgggaccggtggggcatccggttcgagagcgtcgacccgttcaacgagccgtcggccaactggtggaaggccgacgggacgcaggagggttgtcatatcgacgtctcgacccaggccaccatcgtggggcacctggccaaccacctgtcccagcgggggctgtcgaccgtcattactgcgccggatgagtcctactacgaccaggccctccacacgctccagacgatcggcatcagcgcgctcagccgcatcagccgcatccacgtgcacgggtaccagtacgggagtggcaaccgggcgggcctgcgcgaggcggcggcggcggcggggaagcgggtgtggaacagcgagtatggcgacggggtggcctcgggcgagaacatggcgcggtatctgctgcaggatctgcggcagctccggccgaccgcctgggtgtactggcaggtgctcgacggcggcggctggggcctgctggacgccgacaacgacgcgggccggctgggaggtcccacgcaaaagtactttgtgctcgcccagttcgcccggcacatccggcccggcatgcgcatcctcgacggcggcgccgacaacgtggtggccgcctacgacgccgccgccgccaagctcataatcgtcgccgtcaattgggatgccccgcagtacatcaactttgacctgtcgcgcttcgccgggcgccctgccgacggcaccgccgtgccccgctggagcacccagatcgggagcggcgaccgctatgtccaccacgagggcgacaccaccattagcggcaccaagttctggtcctactttgaaaggaacatggtgcagacctttgaggtcgccggagtgcgactgtaaagtatcagcagtaataatagtcaaaataccaatcattggagatatacgcaccttgtagtgaattaattattagtaaataaa

SEQ ID NO: 11 - protein, 482 aa, Chrysosporium lucknowense
MINSSPLLGLALVLATSPLASADSTTIINAGSNWGTWEGWGTSLAWWAKQFGNRDDLADAFFTLKSTTVNSETLPGLGFNIVRYNAGASSWNAVGDERMVESPNIRRSRQMEGFWLDWHDTDPTSSSWDWTVDANQRSALQKAIARGANRTELFSNSPMWWMCKNHNPSGSSDGSENIQSWNLEQHAVYMANVAMMYRDRWGIRFESVDPFNEPSANWWKADGTQEGCHIDVSTQATIVGHLANHLSQRGLSTVITAPDESYYDQALHTLQTIGISALSRISRIHVHGYQYGSGNRAGLREAAAAAGKRVWNSEYGDGVASGENMARYLLQDLRQLRPTAWVYWQVLDGGGWGLLDADNDAGRLGGPTQKYFVLAQFARHIRPGMRILDGGADNVVAAYDAAAAKLIIVAVNWDAPQYINFDLSRFAGRPADGTAVPRWSTQIGSGDRYVHHEGDTTISGTKFWSYFERNMVQTFEVAGVRL

SEQ ID NO: 12 - DNA, 1446 bp, Chrysosporium lucknowense
atgattaattcgtctcctttgttggggttggccttggtgctggccaccagtcccctggcgagcgccgacagcaccacaatcatcaacgctggctcaaactggggcacttgggaaggttggggcacgtctctggcatggtgggccaagcagttcggcaaccgcgatgacctggccgatgccttcttcaccttaaagtcgacgacggtgaattcggagacgctgcccgggcttggcttcaacattgtgcgttacaacgcgggcgcgtcgagctggaacgcggtcggagatgagaggatggtcgagtcccccaacatccggcggtcgcgccagatggaggggttctggctggactggcacgacacggacccgacctcatcgagctgggactggaccgtggacgcgaaccagaggtcggcgctccagaaggcgatcgcgcgcggggccaacaggacggagctcttctccaactcgcccatgtggtggatgtgcaagaaccacaacccgtccgggtccagcgacggcagcgagaacatccagtcgtggaacctggagcagcacgccgtctacatggccaacgttgccatgatgtaccgggaccggtggggcatccggttcgagagcgtcgacccgttcaacgagccgtcggccaactggtggaaggccgacgggacgcaggagggttgtcatatcgacgtctcgacccaggccaccatcgtggggcacctggccaaccacctgtcccagcgggggctgtcgaccgtcattactgcgccggatgagtcctactacgaccaggccctccacacgctccagacgatcggcatcagcgcgctcagccgcatcagccgcatccacgtgcacgggtaccagtacgggagtggcaaccgggcgggcctgcgcgaggcggcggcggcggcggggaagcgggtgtggaacagcgagtatggcgacggggtggcctcgggcgagaacatggcgcggtatctgctgcaggatctgcggcagctccggccgaccgcctgggtgtactggcaggtgctcgacggcggcggctggggcctgctggacgccgacaacgacgcgggccggctgggaggtcccacgcaaaagtactttgtgctcgcccagttcgcccggcacatccggcccggcatgcgcatcctcgacggcggcgccgacaacgtggtggccgcctacgacgccgccgccgccaagctcataatcgtcgccgtcaattgggatgccccgcagtacatcaactttgacctgtcgcgcttcgccgggcgccctgccgacggcaccgccgtgccccgctggagcacccagatcgggagcggcgaccgctatgtccaccacgagggcgacaccaccattagcggcaccaagttctggtcctactttgaaaggaacatggtgcagacctttgaggtcgccggagtgcgactg

SEQ ID NO: 13 - DNA, 1716 bp, Chrysosporium lucknowense
  CDS (113)..(413)
  CDS (502)..(1334)
ctttataacaaggcccgacccgagctcacgacagcgacgccgtgactctttctctgttggttaggccaagtcattattacccgaaccagagagagacgtctagacggtcaatatgaagtggtccacgctcatcccctctgtccttgttccccttgtctcggctgctcccaaggagcgggaggagaagcccgagaccttctcgcagcgcgttatcttcacgccgcccgacaactacaccgacccgcgcgtgctgtacgcccgcaccgcccagttccgggacggcaccctgctcgcgacctgggagaattacagcccggagccccctccggtctacttccccatctaccgctccactgacggcggctacaactggaaggaaatctcgcgtgtcgaggacacggccaacggattgggtaggggtttttttttttttaacgtttcgtggattcggcggtccgagggcgattactaacaacaccgcctctccccccccccctccaggcctccgataccagccgttcctctacatcctggatgagtcctttgccggcttccccaaggacacggtcctgctggccgggagctcgatccccacggacctctcaagcacccagatcgacctgtatgcctcgacggaccgcggcgtgacgtgggagtttgtctcgcacatcgcggccggcggcgtggccatccccaacaacggcgagacccctgtctgggagccgttcctgatgcgcaacggagacacgctcatctgctactactcggaccagcgcgagaacacgacgtacggccagaagatggtgcaccagaccacctcggacctgcgcacctggggccccgtcgtcaacgacgtcacgtcgcccgtctacgaggagcgcccgggcatgccgatcgtcgccaagctgcccaacggcaagtacatcatgacgtacgagcacggcggcagccccgtgctgagcggctaccagttccccgtccactacaaggtcgtgtcggatcccgagcggttcggccccgccaccggcgtgccgctccggaccaccgacggctacatcccgaccggctcgccctacgtcgtctggagccccgtcggcggggagaacggcacggtgatcgccagcgcccacagctcggccgacatctacatcaacacgggcctcgccgagcccgggagcacctggaggcgcgtcgccacgcccgagaagaacgcctacacgcgccatctccgcgtcctcaacgaccctaccaagctgctcatcatgggcgccggccagttgccgccaagcaccaccaaccaggtggagctgagcgtgattgacatcagcaacctgtaaaggggggtggggggggggggggaccggcaaagttctagagaacagtgggtgggtgctggatagggtagagcgactccgttttgagattttgtcaaaaacaacactcgtaagagcaatttccctcgcggtgttgagaaatcaggtattgacacagcgaagcatctcttcgtgatggggccatgacatgcggtggaaccttctcgtgcggtgattgacggatctctatgcattatgaaggagttcgccgcgtgctaggtagcatacaagcggcttagctcagagccacgctccagatcccccaagcgtagcggcgcatatcgtgttgttatatatagtgcccttgacccctctccatatattatacatacatatctataaa

SEQ ID NO: 14 - protein, 378 aa, Chrysosporium lucknowense
MKWSTLIPSVLVPLVSAAPKEREEKPETFSQRVIFTPPDNYTDPRVLYARTAQFRDGTLLATWENYSPEPPPVYFPIYRSTDGGYNWKEISRVEDTANGLGLRYQPFLYILDESFAGFPKDTVLLAGSSIPTDLSSTQIDLYASTDRGVTWEFVSHIAAGGVAIPNNGETPVWEPFLMRNGDTLICYYSDQRENTTYGQKMVHQTTSDLRTWGPVVNDVTSPVYEERPGMPIVAKLPNGKYIMTYEHGGSPVLSGYQFPVHYKVVSDPERFGPATGVPLRTTDGYIPTGSPYVVWSPVGGENGTVIASAHSSADIYINTGLAEPGSTWRRVATPEKNAYTRHLRVLNDPTKLLIMGAGQLPPSTTNQVELSVIDISNL

SEQ ID NO: 15 - DNA, 1134 bp, Chrysosporium lucknowense
atgaagtggtccacgctcatcccctctgtccttgttccccttgtctcggctgctcccaaggagcgggaggagaagcccgagaccttctcgcagcgcgttatcttcacgccgcccgacaactacaccgacccgcgcgtgctgtacgcccgcaccgcccagttccgggacggcaccctgctcgcgacctgggagaattacagcccggagccccctccggtctacttccccatctaccgctccactgacggcggctacaactggaaggaaatctcgcgtgtcgaggacacggccaacggattgggcctccgataccagccgttcctctacatcctggatgagtcctttgccggcttccccaaggacacggtcctgctggccgggagctcgatccccacggacctctcaagcacccagatcgacctgtatgcctcgacggaccgcggcgtgacgtgggagtttgtctcgcacatcgcggccggcggcgtggccatccccaacaacggcgagacccctgtctgggagccgttcctgatgcgcaacggagacacgctcatctgctactactcggaccagcgcgagaacacgacgtacggccagaagatggtgcaccagaccacctcggacctgcgcacctggggccccgtcgtcaacgacgtcacgtcgcccgtctacgaggagcgcccgggcatgccgatcgtcgccaagctgcccaacggcaagtacatcatgacgtacgagcacggcggcagccccgtgctgagcggctaccagttccccgtccactacaaggtcgtgtcggatcccgagcggttcggccccgccaccggcgtgccgctccggaccaccgacggctacatcccgaccggctcgccctacgtcgtctggagccccgtcggcggggagaacggcacggtgatcgccagcgcccacagctcggccgacatctacatcaacacgggcctcgccgagcccgggagcacctggaggcgcgtcgccacgcccgagaagaacgcctacacgcgccatctccgcgtcctcaacgaccctaccaagctgctcatcatgggcgccggccagttgccgccaagcaccaccaaccaggtggagctgagcgtgattgacatcagcaacctg

SEQ ID NO: 16 - DNA, 1796 bp, Chrysosporium lucknowense
  CDS (302)..(661)
  CDS (724)..(880)
  CDS (934)..(965)
  CDS (1023)..(1535)
aaataaaaacgcgagattagccagcagcatgtagcaacgccgggagtcagtttgagcctagatgcaacacaactttgcacaagcgacggtggggacgctgctccccaactgacaatgccctcttgtgccgttagctggactgagccgtggtaggctgtgaagacatatatgtaaagtgccaccattcagcattggcccgcttccgcgccgaaacttttattccctcaacacctggggtcttagcatcaaccgttagcttctcagttctgtgccttcaggggcggcgcaaacagtccttacaatggcaaggctaagatctgtaacgctgggtgccttcatgacactgttctcaccatgggcatgtttggtttttggacttgctgtcgacgttgcgggccatagtagtcaagtggctgcacgggcagacccgaacttggctggttacttgggcgtcttctttctcggagctgacccgtacgtctacttttatctcagcaatggaaacaaccctgtctccttcagggccttgaatggaggctcgccaatcataaagccaacgaaaggcaccgggggagtccgagacccgaccattattccaggaggtggaagcgaagccggcaagaagtggtacatcatcgggacagatctagacattggcaaggtgagctcggtccaggcgcaggttgaaaatgcattttgcgctttgttctgacgttcgaacagacaacgtgggatgcggcgcagcgaaccggatcaagagggatctttgtgtgggaaagcaccgacttgattaactggggtaacgaaagactcgtcgaggtggaagatgccaccgccggcatggtttgggctccagaggcaatctgggatcccgcgaaaggtatggcatttctcatcaggcacgccatgaacatagctagctgactgtcataggccaatacctggttcactgggcatccaaattcgtgaggagctatcacgggaatcgtgctcgtggtgcaacacgcactgactttctgtagtactcgacctccgacccgagccacaccggctctccttccaacattcgcatccgctacgcctacaccagcgacttcaaaaccttcacctccccgcaaaccctcatcgacaaaaaccccactaatatcatcgacttgactattctcccaatcaatggcacggactcgaactccttccttcggttcatgaaagacgagacacgtaaaacagtctttgtcgaggtctccgacaccgggctcttcggcacgtggactaggccaggcggcgattcggcaatcatccagcagggcgtagagggtccggcggcgtactgggacaacacaactccggggaaagcacaccttctgctggatttttacggggaggacggatacaggccgtttgagagcaccaatccgggcagcaacagcggatggacaaggagcgataggtcggcatttccaacgaatttgaggcatgggagtgtgttgccggtggatcaagcggcttatgagacgttaaacgcgcggtggggttaggaacgaacttgagagaaagtgagaaaggggcggcgcaaacagtccaacatggcgctaacgtcgggatactggaggcgggaagctctcttcgattgaggttcttgtccgccagcaacatgacaggctcggacaagagagggatgagaaacgcaagacaatttgcaccttcttgcacctcacaggactgggtccacaaaaggcatcaaaaactgtcgcaggatctcatctgttcatgccaccagaccggaaatacgagta

SEQ ID NO: 17 - protein, 354 aa, Chrysosporium lucknowense
MARLRSVTLGAFMTLFSPWACLVFGLAVDVAGHSSQVAARADPNLAGYLGVFFLGADPYVYFYLSNGNNPVSFRALNGGSPIIKPTKGTGGVRDPTIIPGGGSEAGKKWYIIGTDLDIGKTTWDAAQRTGSRGIFVWESTDLINWGNERLVEVEDATAGMVWAPEAIWDPAKGQYLVHWASKFYSTSDPSHTGSPSNIRIRYAYTSDFKTFTSPQTLIDKNPTNIIDLTILPINGTDSNSFLRFMKDETRKTVFVEVSDTGLFGTWTRPGGDSAIIQQGVEGPAAYWDNTTPGKAHLLLDFYGEDGYRPFESTNPGSNSGWTRSDRSAFPTNLRHGSVLPVDQAAYETLNARWG

SEQ ID NO: 18 - DNA, 1062 bp, Chrysosporium lucknowense
atggcaaggctaagatctgtaacgctgggtgccttcatgacactgttctcaccatgggcatgtttggtttttggacttgctgtcgacgttgcgggccatagtagtcaagtggctgcacgggcagacccgaacttggctggttacttgggcgtcttctttctcggagctgacccgtacgtctacttttatctcagcaatggaaacaaccctgtctccttcagggccttgaatggaggctcgccaatcataaagccaacgaaaggcaccgggggagtccgagacccgaccattattccaggaggtggaagcgaagccggcaagaagtggtacatcatcgggacagatctagacattggcaagacaacgtgggatgcggcgcagcgaaccggatcaagagggatctttgtgtgggaaagcaccgacttgattaactggggtaacgaaagactcgtcgaggtggaagatgccaccgccggcatggtttgggctccagaggcaatctgggatcccgcgaaaggccaatacctggttcactgggcatccaaattctactcgacctccgacccgagccacaccggctctccttccaacattcgcatccgctacgcctacaccagcgacttcaaaaccttcacctccccgcaaaccctcatcgacaaaaaccccactaatatcatcgacttgactattctcccaatcaatggcacggactcgaactccttccttcggttcatgaaagacgagacacgtaaaacagtctttgtcgaggtctccgacaccgggctcttcggcacgtggactaggccaggcggcgattcggcaatcatccagcagggcgtagagggtccggcggcgtactgggacaacacaactccggggaaagcacaccttctgctggatttttacggggaggacggatacaggccgtttgagagcaccaatccgggcagcaacagcggatggacaaggagcgataggtcggcatttccaacgaatttgaggcatgggagtgtgttgccggtggatcaagcggcttatgagacgttaaacgcgcggtggggt

SEQ ID NO: 19 - DNA, 2033 bp, Chrysosporium lucknowense
  CDS (494)..(777)
  CDS (870)..(937)
  CDS (1023)..(1446)
  CDS (1576)..(1759)
atattaatagctgctggaatccttcgctttaccaactcccgcagactgttgcatcgttccctcgtggccagttcgcgcaacgggaatcaacggagaacccggggaataataccccatgcgcctagccagagccgcgatgcgcgccaatagacatgcacgtttcagcgtgtcagaacgggagttcggcggttttgtttccgcaagtgacactgcccccgatcggaatccacttcgatcaacgagagagtttttccgacgtgcatacatgctactacatggtacgagcacgaggaaagctatgttacaagttgtagtctgtaagccgaggtcttatagccatgtagctcacaagatgtgtcaagggagcgcctaatagttctgtaattaataaaccctcacccgggtgctccagcttgaatgaaatactactgcgttcctactctatccttggtaaccctcatctatgccaaattctgtctttaactagcacaagatgaagggtgtttccatcgcaggggccttctcgggcctccttagcttggcctcagctgcctctttctcgaatcctctcaaacccttcaacgggtcagatcctcatatgacctactatgatgggtactattatctgatgacgacaacatggaccgacctgcagataacccgagccaagaccttagagggcctcaaaaacggagagaccagggtggtttggactgactcggatccctcccgctgctgcaatgtctgggcacccgagcttcacaagattgacaacaagtaagtggtcaccatcagccccagcatggttattaattaaactctctttatcaatgataggaggaggttgggctaaaagaaaacatcaataggtggtacatctactacacagctggaaacaaccagaacctagatggccagcggtctcatgtcctagaaggttagtgaaagagcagctgcctgctattttgagcaattaggtctggtaggttctcgaggagactgacttatatacacaaatctaggtggttctgacccgtggggccagtactcctatgccggacagctcacccaagactggggcatcgacggtacgattctccgcgtccagaaccagaactactttgtttggtcctgcttctcggacggtatccagtccctctgcattgcgcctttgcagtcaccgacttcgattggctctccccgagtgctctcgcaaccgctcctggactgggaacgggtcgacactccggttaatgaggggccggcaccgctctaccatgatggaaaaatcttcctcgcctatagtgccagtttctgctggacacctagctaccaactcggcctccttacttacaacgggggggatccgactgcagccagcagctggacaaagacggggcccttcttcagctcggcaaatggaaactacggtccgggacacaattcgtgagtacctccaatagagctcgagcatttccccatcattaccgccgcccctgatcgtgagtcacggggtgtgtgctgcacgctgcctggcagtaggcgctgtacacatactgacctgatcggacccaggtttgtcaatagcccggacggcaccgagatctggaacatctaccatgcgacctccatctcaactggtaattgtgatggcaacaggtacaccgcggccaagaaggtgacctggaattcggatggctctcccaactttggcagccccgatcccctaggcgttgtcactcctgggccctcgggggagtaacggtctccggtggtcctagttataataataacttccgcagtttttagcacggacactgtaacttcattcgccttgttggtaattatgtgtcaccgtgtggaaggcagatcatgaaggtacccagcctatgaaccgtcgacgatgcgtgcatttccatcaagaagaggaaggacctgggaaagacacaatgtacgctatagctgatgatgtccattatggaccaccaacttcgcagctgtttctgccatgatatggtgaaccattgcgggaa

SEQ ID NO: 20 - protein, 320 aa, Chrysosporium lucknowense
MKGVSIAGAFSGLLSLASAASFSNPLKPFNGSDPHMTYYDGYYYLMTTTWTDLQITRAKTLEGLKNGETRVVWTDSDPSRCCNVWAPELHKIDNKWYIYYTAGNNQNLDGQRSHVLEGGSDPWGQYSYAGQLTQDWGIDGTILRVQNQNYFVWSCFSDGIQSLCIAPLQSPTSIGSPRVLSQPLLDWERVDTPVNEGPAPLYHDGKIFLAYSASFCWTPSYQLGLLTYNGGDPTAASSWTKTGPFFSSANGNYGPGHNSFVNSPDGTEIWNIYHATSISTGNCDGNRYTAAKKVTWNSDGSPNFGSPDPLGVVTPGPSGE

SEQ ID NO: 21 - DNA, 960 bp, Chrysosporium lucknowense
atgaagggtgtttccatcgcaggggccttctcgggcctccttagcttggcctcagctgcctctttctcgaatcctctcaaacccttcaacgggtcagatcctcatatgacctactatgatgggtactattatctgatgacgacaacatggaccgacctgcagataacccgagccaagaccttagagggcctcaaaaacggagagaccagggtggtttggactgactcggatccctcccgctgctgcaatgtctgggcacccgagcttcacaagattgacaacaagtggtacatctactacacagctggaaacaaccagaacctagatggccagcggtctcatgtcctagaaggtggttctgacccgtggggccagtactcctatgccggacagctcacccaagactggggcatcgacggtacgattctccgcgtccagaaccagaactactttgtttggtcctgcttctcggacggtatccagtccctctgcattgcgcctttgcagtcaccgacttcgattggctctccccgagtgctctcgcaaccgctcctggactgggaacgggtcgacactccggttaatgaggggccggcaccgctctaccatgatggaaaaatcttcctcgcctatagtgccagtttctgctggacacctagctaccaactcggcctccttacttacaacgggggggatccgactgcagccagcagctggacaaagacggggcccttcttcagctcggcaaatggaaactacggtccgggacacaattcgtttgtcaatagcccggacggcaccgagatctggaacatctaccatgcgacctccatctcaactggtaattgtgatggcaacaggtacaccgcggccaagaaggtgacctggaattcggatggctctcccaactttggcagccccgatcccctaggcgttgtcactcctgggccctcgggggag

SEQ ID NO: 22 - DNA, 1830 bp, Chrysosporium lucknowense
  CDS (104)..(193)
  CDS (283)..(635)
  CDS (716)..(788)
  CDS (853)..(1101)
  CDS (1218)..(1805)
tgaacgttgcattcgtgggcttcgtttggctggctcttgcggggatctaattacgcaacctttccagtttcgcctctggccgctgctgagcaaagcatcaaagatgcgcatttcgtcggccacgctcaccgcggcgctctccagcgttgcctcggcttcgctgcaggtcgtgccaggaggaacatggaccacggtgagttctgccccccttagaatgagtcgaggcgtgtctcgggatcgctaacaagaccacgtcacgccttctcttgttcttgtgagcagccggacggcgagcacttgcaggcccatggtgcaggtttcattgaggtcaacgggacgtactacatgatcggcgaggacaagagcggcggccactcgttcaccaacgtcaactgctactcgtcgacggatcttgtccagtggacctatgtcggcgccctcctctcccagacgagctccggtgatctggggcccaaccgcgtcgtggagcggcccaaggtcatctacaacgacaagacgggcaagtacgtgctctggatgcacatggacagcagcaactacggcgaggcgagggttgccgtcgcaacgggcgactcggtgtgcggcaagtacgaatacatcaggagctttcaaccgtgagtgaaccattttgctgagaacgtcaactttgaccccagacacgctccggatcgcgattgaccctagaacgccgcagactcgggagggagagccgggatatggggcttttcaaggacgacgacggcaaggcctacttgctgaccgaagatgtgcgtcacccgagaggctttcatcaggatgttaggatagcccagcactaaacaagcacgccagagaaactacggcctccgcattgtcgcgctttcggatgactatctgactcccacgactgacgtcttctcctggagactcgagggggggaaccgggtcgaggccccggccatggtcaagctcggcgacacgtacttcttgttcgcctccatgatgaccggatgggaccccaacgacaaccagtacacgacatccaagagcctcggatccggttggtccgagtggaagaagtttgccgaccagggaacaaatgtcagttcggccctcggctgctcatgcttcaagtttctcgcatcattccgttcttgtcgttttctcccccctaccacgcgaagcttggaggctgacgcactagggacctgatttagacgtacaactcgcaaacgacttacatcctcaagacgagcgagagcagcgccatctacatgggcgacaggtgggtcaaggacaatctgatggcgagcacctacgtgtggctgcccctgagcatcagcggcaccagcgtcagcatgaagaactttgtcagctgggtgccgacgtccaacttcgcctcgtggcagaacccgccggccgagacgagctacgaggccgaggcggccacgtacggcggcaaggcgcgcaacatcgactgctccggctgctccggcaaggtcgccgccggctacatcggcggcccggacaacggcagcgtcaccttcaccggcatccgcagcgacatcgacggcctgaccaccatccgcatcaagttcctcaacggcgacagcagtccgcgctacgccaacgtccgcgtcaacggcgacgccggcaggaagatcgccttcctcactgcccgtggcgatcccgcctccagcaccttgcatgcccagctcaagaagggctccgacaacaccatagttatcgagggcatcaacggcggatggggccccgacgtcgaccgcctgatggtgccggtacagtgatttgtagtcgcgtactaattaa

SEQ ID NO: 23 - protein, 451 aa, Chrysosporium lucknowense
MRISSATLTAALSSVASASLQVVPGGTWTTPDGEHLQAHGAGFIEVNGTYYMIGEDKSGGHSFTNVNCYSSTDLVQWTYVGALLSQTSSGDLGPNRVVERPKVIYNDKTGKYVLWMHMDSSNYGEARVAVATGDSVCGKYEYIRSFQPLGRESRDMGLFKDDDGKAYLLTEDRNYGLRIVALSDDYLTPTTDVFSWRLEGGNRVEAPAMVKLGDTYFLFASMMTGWDPNDNQYTTSKSLGSGWSEWKKFADQGTNTYNSQTTYILKTSESSAIYMGDRWVKDNLMASTYVWLPLSISGTSVSMKNFVSWVPTSNFASWQNPPAETSYEAEAATYGGKARNIDCSGCSGKVAAGYIGGPDNGSVTFTGIRSDIDGLTTIRIKFLNGDSSPRYANVRVNGDAGRKIAFLTARGDPASSTLHAQLKKGSDNTIVIEGINGGWGPDVDRLMVPVQ

SEQ ID NO: 24 - DNA, 1353 bp, Chrysosporium lucknowense
atgcgcatttcgtcggccacgctcaccgcggcgctctccagcgttgcctcggcttcgctgcaggtcgtgccaggaggaacatggaccacgccggacggcgagcacttgcaggcccatggtgcaggtttcattgaggtcaacgggacgtactacatgatcggcgaggacaagagcggcggccactcgttcaccaacgtcaactgctactcgtcgacggatcttgtccagtggacctatgtcggcgccctcctctcccagacgagctccggtgatctggggcccaaccgcgtcgtggagcggcccaaggtcatctacaacgacaagacgggcaagtacgtgctctggatgcacatggacagcagcaactacggcgaggcgagggttgccgtcgcaacgggcgactcggtgtgcggcaagtacgaatacatcaggagctttcaaccactcgggagggagagccgggatatggggcttttcaaggacgacgacggcaaggcctacttgctgaccgaagatagaaactacggcctccgcattgtcgcgctttcggatgactatctgactcccacgactgacgtcttctcctggagactcgagggggggaaccgggtcgaggccccggccatggtcaagctcggcgacacgtacttcttgttcgcctccatgatgaccggatgggaccccaacgacaaccagtacacgacatccaagagcctcggatccggttggtccgagtggaagaagtttgccgaccagggaacaaatacgtacaactcgcaaacgacttacatcctcaagacgagcgagagcagcgccatctacatgggcgacaggtgggtcaaggacaatctgatggcgagcacctacgtgtggctgcccctgagcatcagcggcaccagcgtcagcatgaagaactttgtcagctgggtgccgacgtccaacttcgcctcgtggcagaacccgccggccgagacgagctacgaggccgaggcggccacgtacggcggcaaggcgcgcaacatcgactgctccggctgctccggcaaggtcgccgccggctacatcggcggcccggacaacggcagcgtcaccttcaccggcatccgcagcgacatcgacggcctgaccaccatccgcatcaagttcctcaacggcgacagcagtccgcgctacgccaacgtccgcgtcaacggcgacgccggcaggaagatcgccttcctcactgcccgtggcgatcccgcctccagcaccttgcatgcccagctcaagaagggctccgacaacaccatagttatcgagggcatcaacggcggatggggccccgacgtcgaccgcctgatggtgccggtacag

SEQ ID NO: 25 - DNA, 1905 bp, Chrysosporium lucknowense
  CDS (226)..(1899)
gtatataattagtgggaagaaagctcactccgcagtctcctgggtcagggcaatttgcaatgagttgagtctcgatgcttgccttgtgaagcattgaagctccggacagaaaaaagcgtatttacctacactcgtcacgcccagtggcatcctgttggactgcaccgctcgtttccagcataattacacgcaactgatgcgaacaaggcctccgcggtctcggttatgatggggcgcctaaacgatctcatagccctccttgcactgttgagcggcagtgccacatccgctgccgtaagaaacacggcttctcaggctcgcgcggcggaattcaacaacccggtgctctgggaggactatccggacctggacgtgttccgggtcgggtcgaccttctactactcctcctccacgttcgcctactccccgggggctccggtgctcaagtcgtacgacctggtgaactggacccccgtcacccactcggtcccgacgctcaactttggggaccgctacaacctcacgggcggcacgccggccggctacgtcaagggcatctgggcgtcgacgctgcggtaccggccctccaacgacaagttctactggtacggctgcgtcgagttcggcaagacgtacatctggaccagctccggcacgcgcgcgggcgacagggacggcgaggtggaccccgccgactgggtctgggagccgcacccgcccatcgaccggtgctactacgacagcggcctgttgatcgacgacgacgacaagatgtacatcgcgtacggcaaccccaagatcgaggtcgccgagctgtccgacgacgggctcaccgaggtctcctcccgggtcgtctacaccccgccggccggcaccaccatcgagggctcgcgcatgtacaaggtcggcgacgcctactacatcctggtgacgcggccggccgacgccgagtgggtgctccggtcgacgtccgggcccttcggcccgtacgagcagcgcgagctcgtgtcgcgcatcaacgggcccctctccaacgccggcttcgcccaccagggcggcatggtcgacaccccggacggccgcagctggtactacgtcgccttcatggacgcgtacccggggggccgcatccccgtggtcgcgccgctgcgctggacggacgacgggtggcccgaggtggtgacggacgcgcagggcggctggggcgccagctacccggtccccgtggagacgggcaagacggtgccggacgacggctgggagctggacgagttcaggggcggccggctgagccaccactgggagtggaaccacaacccggacccggcccgcttcgcgctcgcgggcggggacgagggcgggctggtgctgcaggcggcgacggtgacggaggacctgttcgcggccaggaacacgctcacgcggaggatcaggggccccaagtcgagcggcacgttccggctggacgtcagcaggatgcgcgacggcgaccgggccggggccgtgctgttccgggacacggcggcgtatatcggcgtgtggaagcaaggggacgaggccaccatcgtcgtagtcgacggccttgagctggctctgagctcctggacgaccgtctcgaccgggagggtggccgagacgggcccgaccctgagcagcacgcaggatgtctggctccggatcgaggccgacatcacgcccgcgttcgggaccaacacggcaaggaccacgactttctcgtacagtgtggacggcgggaagacctttgtccgtcttggcccggccttctcgatgagcaatacttggcaatactttacgggctacaggttcggagtcttcaactttgccaccaaggagcttgggggcgaagtcaaggtcaagagcttccagatgcagcctctgtgaaca

SEQ ID NO: 26 - protein, 558 aa, Chrysosporium lucknowense
MMGRLNDLIALLALLSGSATSAAVRNTASQARAAEFNNPVLWEDYPDLDVFRVGSTFYYSSSTFAYSPGAPVLKSYDLVNWTPVTHSVPTLNFGDRYNLTGGTPAGYVKGIWASTLRYRPSNDKFYWYGCVEFGKTYIWTSSGTRAGDRDGEVDPADWVWEPHPPIDRCYYDSGLLIDDDDKMYIAYGNPKIEVAELSDDGLTEVSSRVVYTPPAGTTIEGSRMYKVGDAYYILVTRPADAEWVLRSTSGPFGPYEQRELVSRINGPLSNAGFAHQGGMVDTPDGRSWYYVAFMDAYPGGRIPVVAPLRWTDDGWPEVVTDAQGGWGASYPVPVETGKTVPDDGWELDEFRGGRLSHHWEWNHNPDPARFALAGGDEGGLVLQAATVTEDLFAARNTLTRRIRGPKSSGTFRLDVSRMRDGDRAGAVLFRDTAAYIGVWKQGDEATIVVVDGLELALSSWTTVSTGRVAETGPTLSSTQDVWLRIEADITPAFGTNTARTTTFSYSVDGGKTFVRLGPAFSMSNTWQYFTGYRFGVFNFATKELGGEVKVKSFQMQPL

SEQ ID NO: 27 - DNA, 1674 bp, Chrysosporium lucknowense
atgatggggcgcctaaacgatctcatagccctccttgcactgttgagcggcagtgccacatccgctgccgtaagaaacacggcttctcaggctcgcgcggcggaattcaacaacccggtgctctgggaggactatccggacctggacgtgttccgggtcgggtcgaccttctactactcctcctccacgttcgcctactccccgggggctccggtgctcaagtcgtacgacctggtgaactggacccccgtcacccactcggtcccgacgctcaactttggggaccgctacaacctcacgggcggcacgccggccggctacgtcaagggcatctgggcgtcgacgctgcggtaccggccctccaacgacaagttctactggtacggctgcgtcgagttcggcaagacgtacatctggaccagctccggcacgcgcgcgggcgacagggacggcgaggtggaccccgccgactgggtctgggagccgcacccgcccatcgaccggtgctactacgacagcggcctgttgatcgacgacgacgacaagatgtacatcgcgtacggcaaccccaagatcgaggtcgccgagctgtccgacgacgggctcaccgaggtctcctcccgggtcgtctacaccccgccggccggcaccaccatcgagggctcgcgcatgtacaaggtcggcgacgcctactacatcctggtgacgcggccggccgacgccgagtgggtgctccggtcgacgtccgggcccttcggcccgtacgagcagcgcgagctcgtgtcgcgcatcaacgggcccctctccaacgccggcttcgcccaccagggcggcatggtcgacaccccggacggccgcagctggtactacgtcgccttcatggacgcgtacccggggggccgcatccccgtggtcgcgccgctgcgctggacggacgacgggtggcccgaggtggtgacggacgcgcagggcggctggggcgccagctacccggtccccgtggagacgggcaagacggtgccggacgacggctgggagctggacgagttcaggggcggccggctgagccaccactgggagtggaaccacaacccggacccggcccgcttcgcgctcgcgggcggggacgagggcgggctggtgctgcaggcggcgacggtgacggaggacctgttcgcggccaggaacacgctcacgcggaggatcaggggccccaagtcgagcggcacgttccggctggacgtcagcaggatgcgcgacggcgaccgggccggggccgtgctgttccgggacacggcggcgtatatcggcgtgtggaagcaaggggacgaggccaccatcgtcgtagtcgacggccttgagctggctctgagctcctggacgaccgtctcgaccgggagggtggccgagacgggcccgaccctgagcagcacgcaggatgtctggctccggatcgaggccgacatcacgcccgcgttcgggaccaacacggcaaggaccacgactttctcgtacagtgtggacggcgggaagacctttgtccgtcttggcccggccttctcgatgagcaatacttggcaatactttacgggctacaggttcggagtcttcaactttgccaccaaggagcttgggggcgaagtcaaggtcaagagcttccagatgcagcctctg

SEQ ID NO: 28 - DNA, 1671 bp, Chrysosporium lucknowense
  CDS (133)..(416)
  CDS (488)..(561)
  CDS (645)..(686)
  CDS (787)..(1004)
  CDS (1155)..(1351)
  CDS (1481)..(1574)
ctatataagattatcacctcgctcttgctcttggcttcctttgtttcttgtccaatcctgttaacctgcccaacaaccctccagaatacccccaacaaaggagaaaacactcctctgagcagcgacatcacgatgaagggactcctcggcgccgccgccctctcgctggccgtcagcgatgtctcggcccactacatctttcagcagctgacgacgggcggcgtcaagcacgctgtgtaccagtacatccgcaagaacaccaactataactcgcccgtgaccgatctgacgtccaacgacctccgctgcaatgtgggtgctaccggtgcgggcaccgataccgtcacggtgcgcgccggcgattcgttcaccttcacgaccgatacgcccgtttaccaccagggcccgacctcgatgtgagcatgccccggagccttccaaacttgcttgtctgggaaacacaacagtcactgacggtagcatccagctacatgtccaaggcccccggcagcgcgtccgactacgacggcagcggcggctggttcaagatcaaggactggggtacgcaaaccaaccctcttctttttcaaattatagccacttgtggcacatcacgactaattaaccgttttgatcaatattaggtgccgactttagcagcggccaggccacctggaccttggcgtgtatgtaattacacctccctcccgtcccctcccttcccctttcctcgagttctccttgactttggagcccgcaactgaccgaacgaaaccttccgtccagctgactacaccgccacgattccggaatgtattccccccggcgactacctgcttcgcatccagcaactcggcatccacaacccttggcccgcgggcatcccccagttctacatctcttgtgcccagatcaccgtgactggtggcggcagtgccaaccccggcccgaccgtctccatcccaggcgccttcaaggagaccgacccgggctacactgtcaacgtgagccttttctcccttccccttcataaccatcaacggattccctcttctccaagcctgccccctcccccccccaataccatctgctgccgagatcccacaaagctaaccaccgaataacaaccaaaaaaaaaaagaaaaaaaacacagatctacaacaacttccacaactacaccgtccctggcccagccgtcttcacctgcaacggtagcggcggcaacaacggcggcggctccaacccagtcaccaccaccaccaccaccaccaccaggccgtccaccagcaccgcccagtcccagccgtcgtcgagcccgaccagcccctccagctgcaccgtcgcgaagtggtacgtctcttaacccccccccccccaaaaaaacccaccacaacccttttttttttaattttttccctttctttctttctttccacattcggtctttgtctcgtaatgactgacggtttttctgtgcaggggccagtgcggaggacagggttacagcggctgcaccgtgtgcgcggccgggtcgacctgccagaagaccaacgactactacagccagtgcttgtagaatgaccacacgaccgacggcgccgcaggggcgggcggttgttgtgtcgttgtacaggcggtgtggttggtagcagtgtgcgcgggagaggata

SEQ ID NO: 29 - protein, 303 aa, Chrysosporium lucknowense
MKGLLGAAALSLAVSDVSAHYIFQQLTTGGVKHAVYQYIRKNTNYNSPVTDLTSNDLRCNVGATGAGTDTVTVRAGDSFTFTTDTPVYHQGPTSIYMSKAPGSASDYDGSGGWFKIKDWGADFSSGQATWTLASDYTATIPECIPPGDYLLRIQQLGIHNPWPAGIPQFYISCAQITVTGGGSANPGPTVSIPGAFKETDPGYTVNIYNNFHNYTVPGPAVFTCNGSGGNNGGGSNPVTTTTTTTTRPSTSTAQSQPSSSPTSPSSCTVAKWGQCGGQGYSGCTVCAAGSTCQKTNDYYSQCL

SEQ ID NO: 30 - DNA, 909 bp, Chrysosporium lucknowense
atgaagggactcctcggcgccgccgccctctcgctggccgtcagcgatgtctcggcccactacatctttcagcagctgacgacgggcggcgtcaagcacgctgtgtaccagtacatccgcaagaacaccaactataactcgcccgtgaccgatctgacgtccaacgacctccgctgcaatgtgggtgctaccggtgcgggcaccgataccgtcacggtgcgcgccggcgattcgttcaccttcacgaccgatacgcccgtttaccaccagggcccgacctcgatctacatgtccaaggcccccggcagcgcgtccgactacgacggcagcggcggctggttcaagatcaaggactggggtgccgactttagcagcggccaggccacctggaccttggcgtctgactacaccgccacgattccggaatgtattccccccggcgactacctgcttcgcatccagcaactcggcatccacaacccttggcccgcgggcatcccccagttctacatctcttgtgcccagatcaccgtgactggtggcggcagtgccaaccccggcccgaccgtctccatcccaggcgccttcaaggagaccgacccgggctacactgtcaacatctacaacaacttccacaactacaccgtccctggcccagccgtcttcacctgcaacggtagcggcggcaacaacggcggcggctccaacccagtcaccaccaccaccaccaccaccaccaggccgtccaccagcaccgcccagtcccagccgtcgtcgagcccgaccagcccctccagctgcaccgtcgcgaagtggggccagtgcggaggacagggttacagcggctgcaccgtgtgcgcggccgggtcgacctgccagaagaccaacgactactacagccagtgcttg

SEQ ID NO: 31 - DNA, 1320 bp, Chrysosporium lucknowense
  CDS (133)..(538)
  CDS (709)..(806)
  CDS (882)..(995)
  CDS (1102)..(1149)
  CDS (1307)..(1309)
gtataaaacgacctactgcttgtgccacttcgtcgcctagacccggcccaagtgagacggtctatctttctggaggaaacaccgttccgcgtaacaaccgaccttggcgctgcccccagataataattaaagatgagatacttcctccagctcgctgcggccgcggcctttgccgtgaacagcgcggcgggtcactacatcttccagcagttcgcgacgggcgggtccaagtacccgccctggaagtacatccggcgcaacaccaacccggactggctgcagaacgggccggtgacggacctgtcgtcgaccgacctgcgctgcaacgtgggcgggcaggtcagcaacgggaccgagaccatcaccttgaacgccggcgacgagttcagcttcatcctcgacacgcccgtctaccatgccggccccacctcgctctacatgtccaaggcgcccggagctgtggccgactacgacggcggcggggcctggttcaagatctacgactggggtccgtcggggacgagctggacgttgagtggtacgtgtgccattatgattgcttttcttatcgtcattatcatcattatcatcattatcattatcattatcattgttgttaattattactactggtgttgttgttcttgctattgtgctggttctcttggcggagtaatcattattattcttctgaccccgtctatccaggcacgtacactcagagaattcccaagtgcatccctgacggcgagtacctcctccgcatccagcagatcgggctccacaaccccggcgccgcgccacaggtacgatccttggttccccgtgattttccaggcttgcttcctcttgcgcaccgtcaactgacacgggacaaaaagttctacatcagctgcgctcaagtcaaggtcgtcgatggcggcagcaccaatccgaccccgaccgcccagattccgggagccttccacagcaacgaccctggcttgactgtcaatgtaagtaagctcggcctcatgcttcctcaagaactgaaccagcaacggccctgcgctgctagatggatctgaatgtagtcaggtaattactgacgactgcctgcagatctacaacgaccctctcaccaactacgtcgtcccgggacctagagttgtaagtctctcttgatgctctccgttgatggtcgcgccttgctgatgtcatcgaagttctcttgctagtcgcactggtagaggatcattggcaggatgagtgtgtcgcaagcgattctgacaatatgactattacctacttgtgacatccgagttagttataatccaagta

SEQ ID NO: 32 - protein, 223 aa, Chrysosporium lucknowense
MRYFLQLAAAAAFAVNSAAGHYIFQQFATGGSKYPPWKYIRRNTNPDWLQNGPVTDLSSTDLRCNVGGQVSNGTETITLNAGDEFSFILDTPVYHAGPTSLYMSKAPGAVADYDGGGAWFKIYDWGPSGTSWTLSGTYTQRIPKCIPDGEYLLRIQQIGLHNPGAAPQFYISCAQVKVVDGGSTNPTPTAQIPGAFHSNDPGLTVNIYNDPLTNYVVPGPRVL

SEQ ID NO: 33 - DNA, 669 bp, Chrysosporium lucknowense
atgagatacttcctccagctcgctgcggccgcggcctttgccgtgaacagcgcggcgggtcactacatcttccagcagttcgcgacgggcgggtccaagtacccgccctggaagtacatccggcgcaacaccaacccggactggctgcagaacgggccggtgacggacctgtcgtcgaccgacctgcgctgcaacgtgggcgggcaggtcagcaacgggaccgagaccatcaccttgaacgccggcgacgagttcagcttcatcctcgacacgcccgtctaccatgccggccccacctcgctctacatgtccaaggcgcccggagctgtggccgactacgacggcggcggggcctggttcaagatctacgactggggtccgtcggggacgagctggacgttgagtggcacgtacactcagagaattcccaagtgcatccctgacggcgagtacctcctccgcatccagcagatcgggctccacaaccccggcgccgcgccacagttctacatcagctgcgctcaagtcaaggtcgtcgatggcggcagcaccaatccgaccccgaccgcccagattccgggagccttccacagcaacgaccctggcttgactgtcaatatctacaacgaccctctcaccaactacgtcgtcccgggacctagagtttta

SEQ ID NO: 34 - DNA, 1355 bp, Chrysosporium lucknowense
  CDS (193)..(318)
  CDS (402)..(495)
  CDS (586)..(929)
  CDS (1062)..(1223)
ctaccctgtggtcgatcttcgagacacagacgagccagcatcattcactagatagccgcgcgcccagctgttaattatacgccaaactcgtgtggggattccgcttgatataggactgcatcgccgcccagcagcagagagagcaccaggatcgccaacaacttctcagtccaaagccttagttgaccgaaaatgaagtcgtctaccccggccttgttcgccgctgggctccttgctcagcatgctgcggcccactccatcttccagcaggcgagcagcggctcgaccgactttgatacgctgtgcacccggatgccggtcagtcacagacaaccgcccctggttatctgcccagagactcttgggcggcgaactaacattttctaacattttctcatcagcccaacaatagccccgtcactagtgtgaccagcggcgacatgacctgcaaagtcggcggcaccaagggggtgttcggcttttgcgaggtgaacggtacgggctcccgacttctagaccagtccccgcttgattgatttcgccgttgtctactaacacgtaggcctcctttcctcccccggctagccggcgacgagttcacggttgagatgcacgcgcagcccggcgaccgctcgtgcgccaacgaggccatcggcgggaaccacttcggcccggtcctcatctacatgagcaaggtcgacgacgcctccaccgccgacgggtccggcgactggttcaaggtggacgagttcggctacgacgcaagcaccaagacctggggcaccgacaagctcaacgagaactgcggcaagcgcaccttcaacatccccagccacatccccgcgggcgactatctcgtccgggccgaggctatcgcgctacacactgccaaccagccaggcggcgcgcagttctacatgagctgctatgtaagtttctggagtctcgagctcttccccgtcccttgccgttctcttcgttcttcttcctcttcgttctccttcctcccttcattcgggtgatgtcttcccgctaactgtttctcttcctacaattaatagcaagtcaggatttccggcggcgaagggggccagctgcctgccggagtcaagatcccgggcgcgtacagtgccaacgaccccggcatccttgtcgacatctggggtaacgatttcaacgagtacgttattccgggccccccggtcatcgacagcagctacttctgagttggcgaggtttcgtcgttggagcaagaccccggagtacaggttggcatctgtcatggaggactcctctttactcctcctttccctacaccttggtgatctaattagaacccataacaatcaaataca

SEQ ID NO: 35 - protein, 242 aa, Chrysosporium lucknowense
MKSSTPALFAAGLLAQHAAAHSIFQQASSGSTDFDTLCTRMPPNNSPVTSVTSGDMTCKVGGTKGVFGFCEVNAGDEFTVEMHAQPGDRSCANEAIGGNHFGPVLIYMSKVDDASTADGSGDWFKVDEFGYDASTKTWGTDKLNENCGKRTFNIPSHIPAGDYLVRAEAIALHTANQPGGAQFYMSCYQVRISGGEGGQLPAGVKIPGAYSANDPGILVDIWGNDFNEYVIPGPPVIDSSYF

SEQ ID NO: 36 - DNA, 726 bp, Chrysosporium lucknowense
atgaagtcgtctaccccggccttgttcgccgctgggctccttgctcagcatgctgcggcccactccatcttccagcaggcgagcagcggctcgaccgactttgatacgctgtgcacccggatgccgcccaacaatagccccgtcactagtgtgaccagcggcgacatgacctgcaaagtcggcggcaccaagggggtgttcggcttttgcgaggtgaacgccggcgacgagttcacggttgagatgcacgcgcagcccggcgaccgctcgtgcgccaacgaggccatcggcgggaaccacttcggcccggtcctcatctacatgagcaaggtcgacgacgcctccaccgccgacgggtccggcgactggttcaaggtggacgagttcggctacgacgcaagcaccaagacctggggcaccgacaagctcaacgagaactgcggcaagcgcaccttcaacatccccagccacatccccgcgggcgactatctcgtccgggccgaggctatcgcgctacacactgccaaccagccaggcggcgcgcagttctacatgagctgctatcaagtcaggatttccggcggcgaagggggccagctgcctgccggagtcaagatcccgggcgcgtacagtgccaacgaccccggcatccttgtcgacatctggggtaacgatttcaacgagtacgttattccgggccccccggtcatcgacagcagctacttc

SEQ ID NO: 37 - DNA, 1423 bp, Chrysosporium lucknowense
  CDS (213)..(310)
  CDS (381)..(948)
  CDS (1035)..(1133)
caataaaaaaatgaaggaggccatccgcagccggtgcaggcatggatggatataagaaaacatccagtgtcgcactgcttcgcttccgattcttcgcgttcctggctcagaagttctgcttccttctgaccaaacccttccctgccgccaagccaagcccatccactcctctcctcctcctggtaccttagccagcagcttgcgaccccatcatgtaccgcacgctcggttccattgccctgctcgcggggggcgctgccgcccacggcgccgtgaccagctacaacattgcgggcaaggactaccctgggtaaggatcccgacaatgaccttgggatctctcttcctctctttctctaataacacgaaccactctgcagatactcgggcttcgcccctaccggccaggatgtcatccagtggcaatggcccgactataaccccgtgctgtccgccagcgaccccaagctccgctgcaacggcggcaccggggcggcgctgtatgccgaggcggcccccggcgacaccatcacggccacctgggcccagtggacgcactcccagggcccgatcctggtgtggatgtacaagtgccccggcgacttcagctcctgcgacggctccggcgcgggttggttcaagatcgacgaggccggcttccacggcgacggcacgaccgtcttcctcgacaccgagaccccctcgggctgggacattgccaagctggtcggcggcaacaagtcgtggagcagcaagatccctgacggcctcgccccgggcaattacctggtccgccacgagctcatcgccctgcaccaggccaacaacccgcaattctaccccgagtgcgcccagatcaaggtcaccggctctggcaccgccgagcccgccgcctcctacaaggccgccatccccggctactgccagcagagcgaccccaacatttcggtaaggagaaattcccggccaaaagatgaccccaatcatctccccccctcttctctctttccgatgctaactggtcactcccgcagttcaacatcaacgaccactccctcccgcaggagtacaagatccccggtcccccggtcttcaagggcaccgcctccgccaaggctcgcgctttccaggcctaaagcggtcaacaaggtatcgggtagctcgcgccagcctcggcgcgtttttcctcccgtgccgccggcttcctcttgtgtatatcgcatctgtcaaattccttagggtcatcaaccacgtagcatttgcgcttttgtcctacacctgcgagcgaccagaaccaacggttttgtcacccgcctgaaacatctctttagttagaaagcttggatactttatagcatgttcattctcacaactagaccgatctattagatgagctagagtgagttctgcctcgagaacctca

SEQ ID NO: 38 - protein, 255 aa, Chrysosporium lucknowense
MYRTLGSIALLAGGAAAHGAVTSYNIAGKDYPGYSGFAPTGQDVIQWQWPDYNPVLSASDPKLRCNGGTGAALYAEAAPGDTITATWAQWTHSQGPILVWMYKCPGDFSSCDGSGAGWFKIDEAGFHGDGTTVFLDTETPSGWDIAKLVGGNKSWSSKIPDGLAPGNYLVRHELIALHQANNPQFYPECAQIKVTGSGTAEPAASYKAAIPGYCQQSDPNISFNINDHSLPQEYKIPGPPVFKGTASAKARAFQA

SEQ ID NO: 39 - DNA, 765 bp, Chrysosporium lucknowense
atgtaccgcacgctcggttccattgccctgctcgcggggggcgctgccgcccacggcgccgtgaccagctacaacattgcgggcaaggactaccctggatactcgggcttcgcccctaccggccaggatgtcatccagtggcaatggcccgactataaccccgtgctgtccgccagcgaccccaagctccgctgcaacggcggcaccggggcggcgctgtatgccgaggcggcccccggcgacaccatcacggccacctgggcccagtggacgcactcccagggcccgatcctggtgtggatgtacaagtgccccggcgacttcagctcctgcgacggctccggcgcgggttggttcaagatcgacgaggccggcttccacggcgacggcacgaccgtcttcctcgacaccgagaccccctcgggctgggacattgccaagctggtcggcggcaacaagtcgtggagcagcaagatccctgacggcctcgccccgggcaattacctggtccgccacgagctcatcgccctgcaccaggccaacaacccgcaattctaccccgagtgcgcccagatcaaggtcaccggctctggcaccgccgagcccgccgcctcctacaaggccgccatccccggctactgccagcagagcgaccccaacatttcgttcaacatcaacgaccactccctcccgcaggagtacaagatccccggtcccccggtcttcaagggcaccgcctccgccaaggctcgcgctttccaggcc

SEQ ID NO: 40 - DNA, 1307 bp, Chrysosporium lucknowense
  CDS (98)..(665)
  CDS (759)..(817)
  CDS (913)..(996)
actcgtcctttgcttccaccctcaggacagcatcctctggttcgttgcccccgctgccataaacaacctttatttttttttccacttcttgcccgccatgaaggttctcgcgcccctgattctggccggtgccgccagcgcccacaccatcttctcatccctcgaggtgggcggcgtcaaccagggcatcgggcagggtgtccgcgtgccgtcgtacaacggtccgatcgaggacgtgacgtccaactcgatcgcctgcaacgggccccccaacccgacgacgccgaccaacaaggtcatcacggtccgggccggcgagacggtgacggccgtctggcggtacatgctgagcaccaccggctcggcccccaacgacatcatggacagcagccacaagggcccgaccatggcctacctcaagaaggtcgacaacgccaccaccgactcgggcgtcggcggcggctggttcaagatccaggaggacggccttaccaacggcgtctggggcaccgagcgcgtcatcaacggccagggccgccacaacatcaagatccccgagtgcatcgcccccggccagtacctcctccgcgccgagatgcttgccctgcacggagcttccaactaccccggcgctcagttctacatggagtgcgcccagctcaatagtacgtttgtccagagggaaaaaaaaaaggaaaataaagaaaaaaaaaagcggcgggacagatgtgatggctaacattgatcttcttctccagtcgtcggcggcaccggcagcaagacgccgtccaccgtcagcttcccgggcgcttacaaggtacatacgttgtttaatatatgttgctattttccgaattaccgcccctgtgtaatgattaattacaacattactaacgcggtcgtgatcgacagggtaccgaccccggagtcaagatcaacatctactggccccccgtcaccagctaccagattcccggccccggcgtgttcacctgctaaagcctctgtggcccatggatggtcgttggctagacgtgttcttgggtcatcatcgtggtatctctcttgcctacggtacttcctgtttgttgtacatactcgggaatctcaacaatcttccttcttgtggaccttctggtcaccttgtcaacccacccgaagccgcatggtcggactctttgtgatacatggttagtgatcaagggggttttgctttcgaacttggtcgcattgtttgggaaccatgatcatcacgaactcgaatctgccaagtcggacaatgccattgtcgagtctgtcacaacaaa

SEQ ID NO: 41 - protein, 237 aa, Chrysosporium lucknowense
MKVLAPLILAGAASAHTIFSSLEVGGVNQGIGQGVRVPSYNGPIEDVTSNSIACNGPPNPTTPTNKVITVRAGETVTAVWRYMLSTTGSAPNDIMDSSHKGPTMAYLKKVDNATTDSGVGGGWFKIQEDGLTNGVWGTERVINGQGRHNIKIPECIAPGQYLLRAEMLALHGASNYPGAQFYMECAQLNIVGGTGSKTPSTVSFPGAYKGTDPGVKINIYWPPVTSYQIPGPGVFTC

SEQ ID NO: 42 - DNA, 711 bp, Chrysosporium lucknowense
atgaaggttctcgcgcccctgattctggccggtgccgccagcgcccacaccatcttctcatccctcgaggtgggcggcgtcaaccagggcatcgggcagggtgtccgcgtgccgtcgtacaacggtccgatcgaggacgtgacgtccaactcgatcgcctgcaacgggccccccaacccgacgacgccgaccaacaaggtcatcacggtccgggccggcgagacggtgacggccgtctggcggtacatgctgagcaccaccggctcggcccccaacgacatcatggacagcagccacaagggcccgaccatggcctacctcaagaaggtcgacaacgccaccaccgactcgggcgtcggcggcggctggttcaagatccaggaggacggccttaccaacggcgtctggggcaccgagcgcgtcatcaacggccagggccgccacaacatcaagatccccgagtgcatcgcccccggccagtacctcctccgcgccgagatgcttgccctgcacggagcttccaactaccccggcgctcagttctacatggagtgcgcccagctcaatatcgtcggcggcaccggcagcaagacgccgtccaccgtcagcttcccgggcgcttacaagggtaccgaccccggagtcaagatcaacatctactggccccccgtcaccagctaccagattcccggccccggcgtgttcacctgc

SEQ ID NO: 43 - DNA, 1660 bp, Chrysosporium lucknowense
  CDS (131)..(1156)
ttataaaagggtcacttggaaccccagccgaagacccgggagcttcaccagtcgaccgtcagcccacaacgcccgtgtctgtcccaagccataccatcgtctcttgactggttctagaaacgtaatcgacatgtccaaggcctctgctctcctcgctggcctgacgggcgcggccctcgtcgctgcacatggccacgtcagccacatcgtcgtcaacggcgtctactacaggaactacgaccccacgacagactggtaccagcccaacccgccaacagtcatcggctggacggcagccgatcaggataatggcttcgttgaacccaacagctttggcacgccagatatcatctgccacaagagcgccacccccggcggcggccacgctaccgttgctgccggagacaagatcaacatcgtctggacccccgagtggcccgaatcccacatcggccccgtcattgactacctagccgcctgcaacggtgactgcgagaccgtcgacaagtcgtcgctgcgctggttcaagattgacggcgccggctacgacaaggccgccggccgctgggccgccgacgctctgcgcgccaacggcaacagctggctcgtccagatcccgtcggatctcaaggccggcaactacgtcctccgccacgagatcatcgccctccacggtgctcagagccccaacggcgcccaggcctacccgcagtgcatcaacctccgcgtcaccggcggcggcagcaacctgcccagcggcgtcgccggcacctcgctgtacaaggcgaccgacccgggcatcctcttcaacccctacgtctcctccccggattacaccgtccccggcccggccctcattgccggcgccgccagctcgatcgcccagagcacgtcggtcgccactgccaccggcacggccaccgttcccggcggcggcggcgccaaccctaccgccaccaccaccgccgccacctccgccgccccgagcaccaccctgaggacgaccactacctcggccgcgcagactaccgccccgccctccggcgatgtgcagaccaagtacggccagtgtggtggcaacggatggacgggcccgacggtgtgcgcccccggctcgagctgctccgtcctcaacgagtggtactcccagtgtttgtaagggagatcgttgccggcgagaaagggatgcatgatgatgatgatgatgatgtgatgtagttcgagattgggatgtggctacactacacacatcttaggtttgggagcttcattgtacatagtttttgcatgatcgtgtatacgggagctttattcttgtccggtgcctaccacttggctgggtctgatgcccttttcgcttcataagatgtctcgatacgcctttgcggtttaggtgctgtattcgccttgccagactgcctttgcttgagggcagctgcatgtagtcttgcgcccgggcgccaagcagttcccacggcgggtgctcacatcaacatggatttaaatgcataacatttccaagtaccagcgctaaccaagccgtacttgtattatccgtttatcgaccccaacttttgtacatacataggcgccaaactagagctacaaacccgagcccgaggccgggatgccataacaaatcgtgagcggggaatcacta

SEQ ID NO: 44 - protein, 342 aa, Chrysosporium lucknowense
MSKASALLAGLTGAALVAAHGHVSHIVVNGVYYRNYDPTTDWYQPNPPTVIGWTAADQDNGFVEPNSFGTPDIICHKSATPGGGHATVAAGDKINIVWTPEWPESHIGPVIDYLAACNGDCETVDKSSLRWFKIDGAGYDKAAGRWAADALRANGNSWLVQIPSDLKAGNYVLRHEIIALHGAQSPNGAQAYPQCINLRVTGGGSNLPSGVAGTSLYKATDPGILFNPYVSSPDYTVPGPALIAGAASSIAQSTSVATATGTATVPGGGGANPTATTTAATSAAPSTTLRTTTTSAAQTTAPPSGDVQTKYGQCGGNGWTGPTVCAPGSSCSVLNEWYSQCL

SEQ ID NO: 45 - DNA, 1026 bp, Chrysosporium lucknowense
atgtccaaggcctctgctctcctcgctggcctgacgggcgcggccctcgtcgctgcacatggccacgtcagccacatcgtcgtcaacggcgtctactacaggaactacgaccccacgacagactggtaccagcccaacccgccaacagtcatcggctggacggcagccgatcaggataatggcttcgttgaacccaacagctttggcacgccagatatcatctgccacaagagcgccacccccggcggcggccacgctaccgttgctgccggagacaagatcaacatcgtctggacccccgagtggcccgaatcccacatcggccccgtcattgactacctagccgcctgcaacggtgactgcgagaccgtcgacaagtcgtcgctgcgctggttcaagattgacggcgccggctacgacaaggccgccggccgctgggccgccgacgctctgcgcgccaacggcaacagctggctcgtccagatcccgtcggatctcaaggccggcaactacgtcctccgccacgagatcatcgccctccacggtgctcagagccccaacggcgcccaggcctacccgcagtgcatcaacctccgcgtcaccggcggcggcagcaacctgcccagcggcgtcgccggcacctcgctgtacaaggcgaccgacccgggcatcctcttcaacccctacgtctcctccccggattacaccgtccccggcccggccctcattgccggcgccgccagctcgatcgcccagagcacgtcggtcgccactgccaccggcacggccaccgttcccggcggcggcggcgccaaccctaccgccaccaccaccgccgccacctccgccgccccgagcaccaccctgaggacgaccactacctcggccgcgcagactaccgccccgccctccggcgatgtgcagaccaagtacggccagtgtggtggcaacggatggacgggcccgacggtgtgcgcccccggctcgagctgctccgtcctcaacgagtggtactcccagtgtttg

SEQ ID NO: 46 - DNA, 1962 bp, Chrysosporium lucknowense
  CDS (708)..(1008)
  CDS (1106)..(1372)
  CDS (1593)..(1942)
aatgaaatggggtcggatctagaaccaaagagccgtcggaagccctcgaccggcgggatgcagcgccggagttcggaccgatgccgtcagtcagggtgacaacgaggaagagatttgtgttgttgctgggctctgggggaccaccgttagtgtgtcgggggcttacccaccccttccaatctcgtcaaaccgggttcgtgggcgccttaaggttgcaaggagtggaggagatccgggggtggacaaggggtccggcgttggtgaagatggagccgcatgcgcacaagctccgggggggctagaacgcgggagctcaatcagtggctccgatggaacgcgccaagccagcccaatgtcgttctgtcaaggaggctgcttccgcttcctatttgagtagccgccgaacccggtgatggcggccgctggctcccgaaagatgagggacccgcaaggatttttgggggggggggggggaggagtaggaagagagtcgacaaatatagaatatgtatatatatgttaggggaatggccgcctcgggtcttggaagaggagactgagagtcagtcaaggcgtctaagagagagcgttcttccgtggaatctagacagacaccgacagcagcacggtacctcctctagtcccccccccttctttctcctacagaaagaggatttcataccaagaaagaccacagcgcggccaagatgaagccctttagcctcgtcgccctggcgactgccgtgagcggccatgccatcttccagcgggtgtcggtcaacgggcaggaccagggccagctcaagggggtgcgggcgccgtcgagcaactccccgatccagaacgtcaacgatgccaacatggcctgcaacgccaacattgtgtaccacgacaacaccatcatcaaggtgcccgcgggagcccgcgtcggcgcgtggtggcagcacgtcatcggcgggccgcagggcgccaacgacccggacaacccgatcgccgcctcccacaagggtatgatgatcgatgatgcctctctcttccccccgttcttgatgaacaggcgatggctcccaggaacacacgtgactgaccaccgaatccgaatccaggccccatccaggtctacctggccaaggtggacaacgcggcgacggcgtcgccgtcgggcctcaagtggttcaaggtggccgagcgcggcctgaacaacggcgtgtgggccgtcgacgagctcatcgccaacaacggctggcactacttcgacctgccgtcgtgcgtggcccccggccagtacctgatgcgcgtcgagctgctcgccctgcacagcgcctcgagccccggcggcgcccagttctacatgggctgtgcacagatcgaaggtgcgtcgatctttgttccccttccgtgtcctctctgatcctttctctcttccttttcttccttttactccctttccttctatcttcggagaagcaacgaaaggggaaagggatagaagagaggaatgaaagacgacgaaagagaggattggggaaagacaagacagggaaaaaaaaaaaaaaaaaaaacagagtgagctaacaagaacggttaaccagtcactggctccggcaccaactcgggctccgactttgtctcgttccccggcgcctactcggccaacgacccgggcatcttgctgagcatctacgacagctcgggcaagcccaacaatggcgggcgctcgtacccgatccccggcccgcgccccatctcctgctccggcagcggcggcggcggcaacaacggcggcgacggcggcgacgacaacaacggtggtggcaacaacaacggcggcggcagcgtccccctgtacgggcagtgcggcggcatcggctacacgggcccgaccacctgtgcccagggaacttgcaaggtgtcgaacgaatactacagccagtgcctcccctagagctccccaagaagaaa

SEQ ID NO: 47 - protein, 306 aa, Chrysosporium lucknowense
MKPFSLVALATAVSGHAIFQRVSVNGQDQGQLKGVRAPSSNSPIQNVNDANMACNANIVYHDNTIIKVPAGARVGAWWQHVIGGPQGANDPDNPIAASHKGPHPGLPGQGGQRGDGVAVGPQVVQGGRARPEQRRVGRRRAHRQQRLALLRPAVVRGPRPVPDARRAARPAQRLEPRRRPVLHGLCTDRITGSGTNSGSDFVSFPGAYSANDPGILLSIYDSSGKPNNGGRSYPIPGPRPISCSGSGGGGNNGGDGGDDNNGGGNNNGGGSVPLYGQCGGIGYTGPTTCAQGTCKVSNEYYSQCLP

SEQ ID NO: 48 - DNA, 918 bp, Chrysosporium lucknowense
atgaagccctttagcctcgtcgccctggcgactgccgtgagcggccatgccatcttccagcgggtgtcggtcaacgggcaggaccagggccagctcaagggggtgcgggcgccgtcgagcaactccccgatccagaacgtcaacgatgccaacatggcctgcaacgccaacattgtgtaccacgacaacaccatcatcaaggtgcccgcgggagcccgcgtcggcgcgtggtggcagcacgtcatcggcgggccgcagggcgccaacgacccggacaacccgatcgccgcctcccacaaggggccccatccaggtctacctggccaaggtggacaacgcggcgacggcgtcgccgtcgggcctcaagtggttcaaggtggccgagcgcggcctgaacaacggcgtgtgggccgtcgacgagctcatcgccaacaacggctggcactacttcgacctgccgtcgtgcgtggcccccggccagtacctgatgcgcgtcgagctgctcgccctgcacagcgcctcgagccccggcggcgcccagttctacatgggctgtgcacagatcgaatcactggctccggcaccaactcgggctccgactttgtctcgttccccggcgcctactcggccaacgacccgggcatcttgctgagcatctacgacagctcgggcaagcccaacaatggcgggcgctcgtacccgatccccggcccgcgccccatctcctgctccggcagcggcggcggcggcaacaacggcggcgacggcggcgacgacaacaacggtggtggcaacaacaacggcggcggcagcgtccccctgtacgggcagtgcggcggcatcggctacacgggcccgaccacctgtgcccagggaacttgcaaggtgtcgaacgaatactacagccagtgcctcccc

SEQ ID NO: 49 - DNA, 1019 bp, Chrysosporium lucknowense
  CDS (118)..(488)
  CDS (563)..(929)
gtataaataccggggcgagttgcccctggtagtttggtctttcaaccccccacccccaggccgactcgagtctctctctccccccgtctcagcccataatcacagccacaggtcgccatgaagctctccctcttttccgtcctggccactgccctcaccgtcgaggggcatgccatcttccagaaggtctccgtcaacggagcggaccagggctccctcaccggcctccgcgctcccaacaacaacaaccccgtgcagaatgtcaacagccaggacatgatctgcggccagtcgggatcgacgtcgaacactatcatcgaggtcaaggccggcgataggatcggtgcctggtatcagcatgtcatcggcggtgcccagttccccaacgacccagacaacccgattgccaagtcgcacaagggccccgtcatggcctacctcgccaaggttgacaatgccgcaaccgccagcaagacgggcctgaagtggtatgtattcccgcggcccgagggacatcaggttgggcaagtcgagactgacggagctcgcttctcccgtataggttcaagatttgggaggatacctttaatcccagcaccaagacctggggtgtcgacaacctcatcaacaacaacggctgggtgtacttcaacctcccgcagtgcatcgccgacggcaactacctcctccgcgtcgaggtcctcgctctgcactcggcctactcccagggccaggctcagttctaccagtcctgcgcccagatcaacgtatccggcggcggctccttcacgccggcgtcgactgtcagcttcccgggtgcctacagcgccagcgaccccggtatcctgatcaacatctacggcgccaccggccagcccgacaacaacggccagccgtacactgcccctgggcccgcgcccatctcctgctgatcatcggtagtggtgcgacggtctaggccaaccgttctaagtgatgctttgattcaacttaagagagaggtaagaggaaatagggga

SEQ ID NO: 50 - protein, 246 aa, Chrysosporium lucknowense
MKLSLFSVLATALTVEGHAIFQKVSVNGADQGSLTGLRAPNNNNPVQNVNSQDMICGQSGSTSNTIIEVKAGDRIGAWYQHVIGGAQFPNDPDNPIAKSHKGPVMAYLAKVDNAATASKTGLKWFKIWEDTFNPSTKTWGVDNLINNNGWVYFNLPQCIADGNYLLRVEVLALHSAYSQGQAQFYQSCAQINVSGGGSFTPASTVSFPGAYSASDPGILINIYGATGQPDNNGQPYTAPGPAPISC

SEQ ID NO: 51 - DNA, 738 bp, Chrysosporium lucknowense
atgaagctctccctcttttccgtcctggccactgccctcaccgtcgaggggcatgccatcttccagaaggtctccgtcaacggagcggaccagggctccctcaccggcctccgcgctcccaacaacaacaaccccgtgcagaatgtcaacagccaggacatgatctgcggccagtcgggatcgacgtcgaacactatcatcgaggtcaaggccggcgataggatcggtgcctggtatcagcatgtcatcggcggtgcccagttccccaacgacccagacaacccgattgccaagtcgcacaagggccccgtcatggcctacctcgccaaggttgacaatgccgcaaccgccagcaagacgggcctgaagtggttcaagatttgggaggatacctttaatcccagcaccaagacctggggtgtcgacaacctcatcaacaacaacggctgggtgtacttcaacctcccgcagtgcatcgccgacggcaactacctcctccgcgtcgaggtcctcgctctgcactcggcctactcccagggccaggctcagttctaccagtcctgcgcccagatcaacgtatccggcggcggctccttcacgccggcgtcgactgtcagcttcccgggtgcctacagcgccagcgaccccggtatcctgatcaacatctacggcgccaccggccagcccgacaacaacggccagccgtacactgcccctgggcccgcgcccatctcctgc

SEQ ID NO: 52 - DNA, 5674 bp, Chrysosporium lucknowense
  CDS (4216)..(4458)
  CDS (4602)..(5276)
  CDS (5478)..(5528)
aaaattcttcagcgatcgactggctgtttcaaactgtcttctcgaggttatgcagaatattcaagaccgaatgaatgctgcagtaacgttccgaggacgccattgcgcacttacttgttctttgctttcgctaatgccatcttggtttcatgccgattgttccgggttaagggtgtgctgcgttagttgctcaagagccaagcactcatttgctcaagagccaagcactcatttgcgcatagatgccagcccactaattagtgtactgccgacggtcccacaaccctcggaaagcatggaaaggaccagaaagggcagttgatggcgattttcatcaatccatcaaacaaacttaatccaggttactggctatttcgcctggagccacgggacacacatgtgatcgcattgggatcgcgcgaacgaaggacgacggactgaggatgatggagggaccgggcccgtttcagattcagcgaaagccaaccaatgcagttccggccccgcaacctgccgcttcttgttggggctgcgaggagaagccgccgccgcttccagcacgtcccgggctccgtcccgacgtgcagccattgcaaaggccggcctctcgcggcgcggagccaccgatcttgcagattcctcccggccatggtctccggtcgcaaaagagcatgccagagctctctgcgctggcgggcgactcgcgtacctcgtcccccccgagtccgttcaatgccgcaccggccactccggccgcgactttcgggcccggcgccagcgatggcaagaagtctttcgtgcagaccgccctcgccgaggcacgccacttcgccggcggattgatcccccacccaaccgaatcgacgaagcattacaccatcctccgtcactcaccgcccctcatcttgtaccgcggacccagcacctcggtggaaatcaccattttcagctctcccgatcatccgctcccgccagaccgcaccctttggctgcagcagcgcggcttctctggggactgtggtatgaagatcaaggcgtttttcaacgctaccgacagctggctgcacgtcaccccctcgatgcaggtcgagccagaccaggtcgccgccgacactgaacgtgcctggcagagggacatcggaaaggctgcaaaaaagttgctcaaggacaaggggcccaagaaagctcacgtaccgagagagactcacgtcatccgggtccccgagtcgtcagatgatggatacttccgcatcctcctctgcaccggcaggggcaggcccgacgacgccaccgagggctcgtccaacaaatgcaagacgctgtgcgtcagccccatcttccgcgtcgccagcgcgtcgaccgactcgagcgtgttccggggcgcttccctcagcaccctacccctagagatgggcgtctacgtggcgtccatggtcgccgcctcaaccgtgaacaagtacgccgccccggtccttgaaccggttcagggcgtcatcaacacggtccgaccaggattcgtcgccgagacggttggcgggcttgcgtacgacgaagtgagcgagcgggccgccgagcgggaggcagagcgtgaccgagccttcttagcggcgcaccaggcccacgtcgcccggtcgctccaggcagaccccaacgccatccagcccatcgggcccgactcgggtccggaagcgcccttcccactccagttccagggcaaggtggtcgccggcaccggccgcagccaggccgagctcggcatccccaccgctaacctcttcggcgtccccgacgagatcaagtaccgcctccgcggcaactatttcggctgggcccggctcctccccccaaagcagaaccgacccgccacccgctcagggaccaacgacgcccaatggtaccccgagtgctaccctcctcgatggcaccaagcgatcatcactatcgccccgcactccccctacgcggccccgtccgtcacccccaagccgtacgtggcagtccacctcctccacttcccccctcccaccacgacaacaacgacgccaccctccccggccgccgccaacctcgtcggcaggtccctctccatcacggtcttgggcctactccggccctactccccttcgccagccgcttcggccctgcccaggaacgccaggatggacgggcacgcgcgggacgtgtgcctcacgctcgcgagcctgggccgcgagaactggggccccgagtcgggcgccgtgcgggccgagctggagaggcaggaggccgagaggggggtggcggagcgcgcgagggagcgggcctcccgggcgcaaaagatacccgggcagatgcaccgcatcggggtgcggatgaggtcggtaggggaggaaagggatcggatcaggggggtgggcggatactgggtgaagaggggttgatgatgttttttcattaggaggagaaagacggttttgctttaaaactaactctttttcgatattggcgaagtgatttgggaataggattactactaattagatcttttaattctaataactccgggcccggaatcgtccaacctcggaccatcttcgctaagaatcggttcaaacatgtaatggcatgctactgcacactgatgcgtacactctgcgagtcgatctttcaagaggagcgagccgcttgacaataattaatagtgaccgaccccggttggtgtgcgatgggttccaaggtcagcaacgagggtatcctgctcgacacgtcaccgaaggtatttactcgttctttgagcgctgggcctccttcggcaaacaagttctcagctgtccccaacatccatccactcttgcatatttaagacagaccgaactatcagagcagccaagcgtcagtcggtactcagggccgataccctttcaagcgacccacgaagactggatggactctggaacaagacggctctggcacacgcccatttggttcttggtcttcatgcgcgaagccagtggctctattacacgctcgactactacacacgtggagcagagtgccacgtcctcaagcagagagtggtcagctcgtgagccccgttcaaagtccggggtagcactctcgcggtccggctgcatctcgctcggcatgacttcttgtttctgttctgtcggcgccaccactctgcgcgaggcggccccgtggcgccggaacacacgagttctgattccgtctcctccccctgcctggttgagcaaagatcgacggggaaatcggatgcggcgagccaagcccacgataccaaaatagcatcccacacgtaattaccttggatcaggagatggtggtgtggtgaaaggacggtaattaaacccgttttttctttttttctttttttttttttttttttaccgagcgctgtgggcgttgatctcccgcaccagagtcgatcgcctttttcattgtgagcgcgcatctcatcaaagctcgcacgatcttcgaccgttgcaagacttggcattccggtatttgggattcggaaccgatcgtttccaacccccgcaacccctgcgcagagccaagccgttgcgaaccaacaaagccagaattgggacgggacgtcatccgccgatagcccggtttttgggatcgcggcgcacggcagagccattccgcattgccgcactagtttatccagcatattagccggccccccaaacccaccaatggcccctgccgccgcaccctgttttcggaaggcctgacgcaccccagatccccctttgggtggtatccatgtggggagttggggagtcgcgcgctccgattcttctgttcacggggctgccgccgaggagcgccgagcgtgcttcggcggtgggactcgagaacagaatggaaattggaggactggcggagtcgtcacagctcactgcagtgaaggtttgggtttgcccgggctgcggtgcggatggggaagcccgagttggcgccggccttggtatccgtgggaacgttcatccaggttgccttgcagcccagcgccctgctgggggagagggagtaaagaaggacgtgtgtggatggggcggacggcggacggataccatacctagctatatattatgtatctgcgccgtggcctgtgacaggaaccactcaactcctctgagccttcaggactcttctccccccaaattcctcgacaagtccgactcggtcaggttctgtgtagcaaccatgaagtccttcaccctcaccactctggccgccctggctggcaacgccgccgctcacgcgaccttccaggccctctgggtcgacggcgtcgactacggcgcgcagtgtgcccgtctgcccgcgtccaactcgccggtcaccgacgtgacctccaacgcgatccgctgcaacgccaacccctcgcccgctcggggcaagtgcccggtcaaggccggctcgaccgttacggtcgagatgcatcaggtacgttggatgaatgagagaggaaagaaagcagaagcagaaggggaagggaaagaaaaagaaaaagaaaagaaaaagagaaagaaaaagaaagtggaaaccgtcggactaactgggctcttcttccccccctttgatatcagcaacccggtgaccgctcgtgcagcagcgaggcgatcggcggggcgcactacggccccgtgatggtgtacatgtccaaggtgtcggacgcggcgtcggcggacgggtcgtcgggctggttcaaggtgttcgaggacggctgggccaagaacccgtccggcgggtcgggcgacgacgactactggggcaccaaggacctgaactcgtgctgcgggaagatgaacgtcaagatccccgccgacctgccctcgggcgactacctgctccgggccgaggccctcgcgctgcacacggccggcagcgcgggcggcgcccagttctacatgacctgctaccagctcaccgtgaccggctccggcagcgccagcccgcccaccgtctccttcccgggcgcctacaaggccaccgacccgggcatcctcgtcaacatccacgccccgctgtccggctacaccgtgcccggcccggccgtctactcgggcggctccaccaagaaggccggcagcgcctgcaccggctgcgagtccacttgcgccgtcggctccggccccaccgccaccgtctcccagtcgcccggttccaccgccacctcggcccccggcggcggcggcggctgcaccgtccagaagtaccagcagtgcggcggccagggctacaccggctgcaccaactgcgcggtacgtttttttcttcagcccttttttcccgtctcctcttattatttattccctctggatttcttccttgccttctctgtccatacctctctgcatacatagggagcctagagacgacccctaccctacatctccctatcttatctggttacctaattacttacctcctcaatgtttctggctgctgactttttgctttagtccggctccacctgcagcgcggtctcgccgccctactactcgcagtgcgtctaagttcctaggcagggcacctcctgggtccctgaccctgaccggcagcctcttattataacgacgccttgtcgaggcttgcttagggctctcgacactccaagcattcttgtatatagtttcaacttttgccaactgtgaataca

SEQ ID NO: 53 - protein, 323 aa, Chrysosporium lucknowense
MKSFTLTTLAALAGNAAAHATFQALWVDGVDYGAQCARLPASNSPVTDVTSNAIRCNANPSPARGKCPVKAGSTVTVEMHQQPGDRSCSSEAIGGAHYGPVMVYMSKVSDAASADGSSGWFKVFEDGWAKNPSGGSGDDDYWGTKDLNSCCGKMNVKIPADLPSGDYLLRAEALALHTAGSAGGAQFYMTCYQLTVTGSGSASPPTVSFPGAYKATDPGILVNIHAPLSGYTVPGPAVYSGGSTKKAGSACTGCESTCAVGSGPTATVSQSPGSTATSAPGGGGGCTVQKYQQCGGQGYTGCTNCASGSTCSAVSPPYYSQCV

SEQ ID NO: 54 - DNA, 969 bp, Chrysosporium lucknowense
atgaagtccttcaccctcaccactctggccgccctggctggcaacgccgccgctcacgcgaccttccaggccctctgggtcgacggcgtcgactacggcgcgcagtgtgcccgtctgcccgcgtccaactcgccggtcaccgacgtgacctccaacgcgatccgctgcaacgccaacccctcgcccgctcggggcaagtgcccggtcaaggccggctcgaccgttacggtcgagatgcatcagcaacccggtgaccgctcgtgcagcagcgaggcgatcggcggggcgcactacggccccgtgatggtgtacatgtccaaggtgtcggacgcggcgtcggcggacgggtcgtcgggctggttcaaggtgttcgaggacggctgggccaagaacccgtccggcgggtcgggcgacgacgactactggggcaccaaggacctgaactcgtgctgcgggaagatgaacgtcaagatccccgccgacctgccctcgggcgactacctgctccgggccgaggccctcgcgctgcacacggccggcagcgcgggcggcgcccagttctacatgacctgctaccagctcaccgtgaccggctccggcagcgccagcccgcccaccgtctccttcccgggcgcctacaaggccaccgacccgggcatcctcgtcaacatccacgccccgctgtccggctacaccgtgcccggcccggccgtctactcgggcggctccaccaagaaggccggcagcgcctgcaccggctgcgagtccacttgcgccgtcggctccggccccaccgccaccgtctcccagtcgcccggttccaccgccacctcggcccccggcggcggcggcggctgcaccgtccagaagtaccagcagtgcggcggccagggctacaccggctgcaccaactgcgcgtccggctccacctgcagcgcggtctcgccgccctactactcgcagtgcgtc

SEQ ID NO: 55 - DNA, 1269 bp, Chrysosporium lucknowense
  CDS (223)..(1260)
agtcttctcctttgccaggcacaagccaacctcgagcaaagccattccgttcatttttctttcacccacattcgcttcattgactgaagatccttctttcctgtccttaacaacaaaaagtcgactcattccgctagtcggtacaactaagcttctgaccttgcgagctcccgctgcttgttttcttctccatcgctacatacgcacaactcagcttcgaagatgtcttccttcacctccaagggtctcctttccgccctcatgggcgcggcaacggttgccgcccacggtcacgtcaccaacatcgtcatcaacggcgtctcataccagaacttcgacccattcacgcacccttatatgcagaaccctccgacggttgtcggctggaccgcgagcaacacggacaacggcttcgtcggccccgagtccttctctagcccggacatcatctgccacaagtccgccaccaacgctggcggccatgccgtcgtcgcggccggcgataaggtcttcatccagtgggacacctggcccgagtcgcaccacggtccggtcatcgactatctcgccgactgcggcgacgcgggctgcgagaaggtcgacaagaccacgctcaagttcttcaagatcagcgagtccggcctgctcgacggcactaacgcccccggcaagtgggcgtccgacacgctgatcgccaacaacaactcgtggctggtccagatcccgcccaacatcgccccgggcaactacgtcctgcgccacgagatcatcgccctgcacagcgccggccagcagaacggcgcccagaactaccctcagtgcttcaacctgcaggtcaccggctccggcactcagaagccctccggcgtcctcggcaccgagctctacaaggccaccgacgccggcatcctggccaacatctacacctcgcccgtcacctaccagatccccggcccggccatcatctcgggcgcctccgccgtccagcagaccacctcggccatcaccgcctctgctagcgccatcaccggctccgctaccgccgcgcccacggctgccaccaccaccgccgccgccgccgccaccactaccaccaccgctggctccggtgctaccgccacgccctcgaccggcggctctccttcttccgcccagcctgctcctaccaccgctgccgctacctccagccctgctcgcccgacccgctgcgctggtctgaagaagcgccgtcgccacgcccgtgacgtcaaggttgccctctaaaagaaa

SEQ ID NO: 56 - protein, 346 aa, Chrysosporium lucknowense
MSSFTSKGLLSALMGAATVAAHGHVTNIVINGVSYQNFDPFTHPYMQNPPTVVGWTASNTDNGFVGPESFSSPDIICHKSATNAGGHAVVAAGDKVFIQWDTWPESHHGPVIDYLADCGDAGCEKVDKTTLKFFKISESGLLDGTNAPGKWASDTLIANNNSWLVQIPPNIAPGNYVLRHEIIALHSAGQQNGAQNYPQCFNLQVTGSGTQKPSGVLGTELYKATDAGILANIYTSPVTYQIPGPAIISGASAVQQTTSAITASASAITGSATAAPTAATTTAAAAATTTTTAGSGATATPSTGGSPSSAQPAPTTAAATSSPARPTRCAGLKKRRRHARDVKVAL

SEQ ID NO: 57 - DNA, 1038 bp, Chrysosporium lucknowense
atgtcttccttcacctccaagggtctcctttccgccctcatgggcgcggcaacggttgccgcccacggtcacgtcaccaacatcgtcatcaacggcgtctcataccagaacttcgacccattcacgcacccttatatgcagaaccctccgacggttgtcggctggaccgcgagcaacacggacaacggcttcgtcggccccgagtccttctctagcccggacatcatctgccacaagtccgccaccaacgctggcggccatgccgtcgtcgcggccggcgataaggtcttcatccagtgggacacctggcccgagtcgcaccacggtccggtcatcgactatctcgccgactgcggcgacgcgggctgcgagaaggtcgacaagaccacgctcaagttcttcaagatcagcgagtccggcctgctcgacggcactaacgcccccggcaagtgggcgtccgacacgctgatcgccaacaacaactcgtggctggtccagatcccgcccaacatcgccccgggcaactacgtcctgcgccacgagatcatcgccctgcacagcgccggccagcagaacggcgcccagaactaccctcagtgcttcaacctgcaggtcaccggctccggcactcagaagccctccggcgtcctcggcaccgagctctacaaggccaccgacgccggcatcctggccaacatctacacctcgcccgtcacctaccagatccccggcccggccatcatctcgggcgcctccgccgtccagcagaccacctcggccatcaccgcctctgctagcgccatcaccggctccgctaccgccgcgcccacggctgccaccaccaccgccgccgccgccgccaccactaccaccaccgctggctccggtgctaccgccacgccctcgaccggcggctctccttcttccgcccagcctgctcctaccaccgctgccgctacctccagccctgctcgcccgacccgctgcgctggtctgaagaagcgccgtcgccacgcccgtgacgtcaaggttgccctc

SEQ ID NO: 58 - DNA, 963 bp, Chrysosporium lucknowense
  CDS (107)..(500)
  CDS (572)..(852)
agcggcgttctgaaaaggaggaacagaactaacgaagacgacccaagcataccaaggtcgtgttgattagcacccccgattcttccagttctttccgccatctgcaatgctgacaacaaccttcgccctcctgacggccgctctcggcgtcagcgcccattataccctccccagggtcgggaccggttccgactggcagcacgtgcggcgggctgacaactggcaaaacaacggcttcgtcggcgacgtcaactcggagcagatcaggtgcttccaggcgacccctgccggcgcccaagacgtctacactgttcaggcgggatcgaccgtgacctaccacgccaaccccagtatctaccaccccggccccatgcagttctacctggcccgcgttccggacggacaggacgtcaagtcgtggaccggcgagggtgccgtgtggttcaaggtgtacgaggagcagcctcaatttggcgcccagctgacctggcctagcaacggtgcgttgatcattttccttcttcttccttctttcttccgttgcatatgctaactgttctcttgcttgcaggcaagagctcgttcgaggttcctatccccagctgcattcgggcgggcaactacctcctccgcgctgagcacatcgccctgcacgttgcccaaagccagggcggcgcccagttctacatctcgtgcgcccagctccaggtcactggtggcggcagcaccgagccttctcagaaggtttccttcccgggtgcctacaagtccaccgaccccggcattcttatcaacatcaactaccccgtccctacctcgtaccagaatccgggtccggctgtcttccgttgctaagcgggcacaacaagggaattggaacggggcaatgggggcgggctggagccgcctgcgtccttgttttcttaccctcgccgttcgtacgaatcagggccaagcaaaaca

SEQ ID NO: 59 - protein, 225 aa, Chrysosporium lucknowense
MLTTTFALLTAALGVSAHYTLPRVGTGSDWQHVRRADNWQNNGFVGDVNSEQIRCFQATPAGAQDVYTVQAGSTVTYHANPSIYHPGPMQFYLARVPDGQDVKSWTGEGAVWFKVYEEQPQFGAQLTWPSNGKSSFEVPIPSCIRAGNYLLRAEHIALHVAQSQGGAQFYISCAQLQVTGGGSTEPSQKVSFPGAYKSTDPGILININYPVPTSYQNPGPAVFRC

SEQ ID NO: 60 - DNA, 675 bp, Chrysosporium lucknowense
atgctgacaacaaccttcgccctcctgacggccgctctcggcgtcagcgcccattataccctccccagggtcgggaccggttccgactggcagcacgtgcggcgggctgacaactggcaaaacaacggcttcgtcggcgacgtcaactcggagcagatcaggtgcttccaggcgacccctgccggcgcccaagacgtctacactgttcaggcgggatcgaccgtgacctaccacgccaaccccagtatctaccaccccggccccatgcagttctacctggcccgcgttccggacggacaggacgtcaagtcgtggaccggcgagggtgccgtgtggttcaaggtgtacgaggagcagcctcaatttggcgcccagctgacctggcctagcaacggcaagagctcgttcgaggttcctatccccagctgcattcgggcgggcaactacctcctccgcgctgagcacatcgccctgcacgttgcccaaagccagggcggcgcccagttctacatctcgtgcgcccagctccaggtcactggtggcggcagcaccgagccttctcagaaggtttccttcccgggtgcctacaagtccaccgaccccggcattcttatcaacatcaactaccccgtccctacctcgtaccagaatccgggtccggctgtcttccgttgc

SEQ ID NO: 61 - DNA, 1203 bp, Chrysosporium lucknowense
  CDS (126)..(180)
  CDS (264)..(605)
  CDS (698)..(835)
  CDS (915)..(1060)
attgttttgtgagttttgctgtctggcgtcgccttcaacacacagagtacttgcaagtacttgcaaacaacttcgaagtcgtacctggaaaaaagaaagaaaagaagagaaaaaaaaagtccaacatgaagctgagcgctgccatcgccgtgctcgcggccgcccttgccgaggggcactgtaagccgacacaccctcctgcctcaccttcgcccagcaaatgccggactcgagctcatggaactaattacaacaacgacaagataccttccccagcatcgccaacacggccgactggcaatatgtgcgcatcacgaccaacttccagagcaacggccccgtgacggacgtcaactcggaccagatccggtgctacgagcgcaacccgggcaccggcgcccccggcatctacaacgtcacggccggcacaaccatcaactacaacgccaagtcgtccatctcccacccgggacccatggccttctacattgccaaggttcccgccggccagtcggccgccacctgggacggtaagggcgccgtctggtccaagatccaccaggagatgccgcactttggcaccagcctcacctgggactccaacggtatgctttcttgcttgcttgcttgctttactgctgcatctaattaatagaatccttggctgactactgaatgatgatgatgttactcccaggccgcacctccatgcccgtcaccatcccccgctgtctgcaggacggcgagtatctgctgcgtgcagagcacattgccctccacagcgccggcagccccggcggcgcccagttctacatttcttgtgcccagctctcaggtatgtgattcaccaattcatcgcctacacacgggcattgttcgattgggaaactcgagcaattaacatcttcccgcagtcaccggcggcagcgggacctggaaccccaggaacaaggtgtcgttccccggcgcctacaaggccactgacccgggcatcctgatcaacatctactaccccgtcccgactagctacactcccgctggtccccccgtcgacacctgctaagttacgggctgagaaacaataatacaccggcagaggatggtggtgagacgatttcaatgtatatagttgtcgctgccagttcttctgagcgtgcttcgagtataaacaccatgctgctcttgtcgtcgtgaaataattaa

SEQ ID NO: 62 - protein, 227 aa, Chrysosporium lucknowense
MKLSAAIAVLAAALAEGHYTFPSIANTADWQYVRITTNFQSNGPVTDVNSDQIRCYERNPGTGAPGIYNVTAGTTINYNAKSSISHPGPMAFYIAKVPAGQSAATWDGKGAVWSKIHQEMPHFGTSLTWDSNGRTSMPVTIPRCLQDGEYLLRAEHIALHSAGSPGGAQFYISCAQLSVTGGSGTWNPRNKVSFPGAYKATDPGILINIYYPVPTSYTPAGPPVDTC

SEQ ID NO: 63 - DNA, 681 bp, Chrysosporium lucknowense
atgaagctgagcgctgccatcgccgtgctcgcggccgcccttgccgaggggcactataccttccccagcatcgccaacacggccgactggcaatatgtgcgcatcacgaccaacttccagagcaacggccccgtgacggacgtcaactcggaccagatccggtgctacgagcgcaacccgggcaccggcgcccccggcatctacaacgtcacggccggcacaaccatcaactacaacgccaagtcgtccatctcccacccgggacccatggccttctacattgccaaggttcccgccggccagtcggccgccacctgggacggtaagggcgccgtctggtccaagatccaccaggagatgccgcactttggcaccagcctcacctgggactccaacggccgcacctccatgcccgtcaccatcccccgctgtctgcaggacggcgagtatctgctgcgtgcagagcacattgccctccacagcgccggcagccccggcggcgcccagttctacatttcttgtgcccagctctcagtcaccggcggcagcgggacctggaaccccaggaacaaggtgtcgttccccggcgcctacaaggccactgacccgggcatcctgatcaacatctactaccccgtcccgactagctacactcccgctggtccccccgtcgacacctgc

SEQ ID NO: 64 - DNA, 1178 bp, Chrysosporium lucknowense
  CDS (160)..(599)
  CDS (662)..(758)
  CDS (836)..(1003)
cttcaaaaagggaacgcggacgggaatgcgatttcgataatctctccggacaggattatctgggcccccttccctagccatgagcactgttgccggactgtgacaggaaccacttggcaactaccacacctcctccaaggaacaataaaccaccacacaatgaaggccctctctctccttgcggctgccggggcagtctctgcgcataccatcttcgtccagctcgaagcagacggcacgaggtacccggtttcgtacgggatccgggacccaacctacgacggccccatcaccgacgtcacatccaacgacgttgcttgcaacggcggtccgaacccgacgaccccctccagcgacgtcatcaccgtcaccgcgggcaccaccgtcaaggccatctggaggcacaccctccaatccggcccggacgatgtcatggacgccagccacaagggcccgaccctggcctacatcaagaaggtcggcgatgccaccaaggactcgggcgtcggcggtggctggttcaagatccaggaggacggttacaacaacggccagtggggcaccagcaccgttatctccaacggcggcgagcactacatgtgagtccttcctccgagagaagaccaaaactctcgactatctcgctgacccgtgcaacaagtgacatcccggcctgcatccccgagggtcagtacctcctccgcgccgagatgatcgccctccacgcggccgggtcccccggcggcgctcagctctacgtaagcctctgcccttccccttgattgaatcggcctgcccacccccccttttcaactccgactaacaccattgccagatggaatgtgcccagatcaacatcgtcggcggctccggctcggtgcccagctcgacggtcagcttccccggcgcgtatagccccaacgacccgggtctcctcatcaacatctattccatgtcgccctcgagctcgtacaccatcccgggcccgcccgttttcaagtgctagagtggcggcaacagccagcaacccggcctggtcgtcgagcgcagtcccgacgtccatcggatttggggagtcggattggtcgacatgctgggtggatggatggatgcatacatagtaggggcggtggctgcgtatatgacttctcctttcatagtccatacctttgacgtga

SEQ ID NO: 65 - protein, 235 aa, Chrysosporium lucknowense
MKALSLLAAAGAVSAHTIFVQLEADGTRYPVSYGIRDPTYDGPITDVTSNDVACNGGPNPTTPSSDVITVTAGTTVKAIWRHTLQSGPDDVMDASHKGPTLAYIKKVGDATKDSGVGGGWFKIQEDGYNNGQWGTSTVISNGGEHYIDIPACIPEGQYLLRAEMIALHAAGSPGGAQLYMECAQINIVGGSGSVPSSTVSFPGAYSPNDPGLLINIYSMSPSSSYTIPGPPVFKC

SEQ ID NO: 66 - DNA, 705 bp, Chrysosporium lucknowense
atgaaggccctctctctccttgcggctgccggggcagtctctgcgcataccatcttcgtccagctcgaagcagacggcacgaggtacccggtttcgtacgggatccgggacccaacctacgacggccccatcaccgacgtcacatccaacgacgttgcttgcaacggcggtccgaacccgacgaccccctccagcgacgtcatcaccgtcaccgcgggcaccaccgtcaaggccatctggaggcacaccctccaatccggcccggacgatgtcatggacgccagccacaagggcccgaccctggcctacatcaagaaggtcggcgatgccaccaaggactcgggcgtcggcggtggctggttcaagatccaggaggacggttacaacaacggccagtggggcaccagcaccgttatctccaacggcggcgagcactacattgacatcccggcctgcatccccgagggtcagtacctcctccgcgccgagatgatcgccctccacgcggccgggtcccccggcggcgctcagctctacatggaatgtgcccagatcaacatcgtcggcggctccggctcggtgcccagctcgacggtcagcttccccggcgcgtatagccccaacgacccgggtctcctcatcaacatctattccatgtcgccctcgagctcgtacaccatcccgggcccgcccgttttcaagtgc

SEQ ID NO: 67 - DNA, 1349 bp, Chrysosporium lucknowense
  CDS (114)..(168)
  CDS (271)..(627)
  CDS (753)..(1036)
ctataataaagggacctgtccggacgcaccgccctggagatcttgtgaatctgccgttgatcgtttgccaagccatagaacaggcaagcttcaaagaattcgacacgcccaagatgaagctcacctcgtccctcgctgtcctggccgctgccggcgcccaggctcactgtcagtcaaccctcgaacccaacaacccccccctttttttttttccctaccccccctcctccatctcctcagcctcacttagtagccgctgacaaggactagataccttccctagggccggcactggtggttcgctctctggcgagtgggaggtggtccgcatgaccgagaaccattactcgcacggcccggtcaccgatgtcaccagccccgagatgacctgctatcagtccggcgtgcagggtgcgccccagaccgtccaggtcaaggcgggctcccaattcaccttcagcgtggatccctccatcggccaccccggccctctccagttctacatggctaaggtgccgtcgggccagacggccgccacctttgacggcacgggagccgtgtggttcaagatctaccaagacggcccgaacggcctcggcaccgacagcattacctggcccagcgccggtgcgtgactttcctcccccctccctttttttttttttttttctttcggaactcaagaatctttctctctctctctcccgtcttggccttgaacaaacactaacactcttccttactataattaggcaaaaccgaggtctcggtcaccatccccagctgcatcgaggatggcgagtacctgctccgggtcgagcacatcgcgctccacagcgccagcagcgtgggcggcgcccagttctacatcgcctgcgcccagctctccgtcaccggcggctccggcaccctcaacacgggctcgctcgtctccctgcccggcgcctacaaggccaccgacccgggcatcctcttccagctctactggcccatcccgaccgagtacatcaaccccggcccggcccccgtctcttgctaagcggacggctcgctcggtgggtttcatgatggtatcaggtgcgggactcggggttaaagtgagagagagagcaagtcaggtgaagatggcagggaggggaaaggggtgcaggagggaagaatggatcgagcccctgagaggtggctcactattatcgttcggttgtatatattgtgtctttgaaggacgatgtaaatatgggattgaatgacatgcgacaaactccagtctatctgcgtcgactttgctttgaagtcttccatcctgaccacccaagcatggtaggccctgtgtaacctattacctccta

SEQ ID NO: 68 - protein, 232 aa, Chrysosporium lucknowense
MKLTSSLAVLAAAGAQAHYTFPRAGTGGSLSGEWEVVRMTENHYSHGPVTDVTSPEMTCYQSGVQGAPQTVQVKAGSQFTFSVDPSIGHPGPLQFYMAKVPSGQTAATFDGTGAVWFKIYQDGPNGLGTDSITWPSAGKTEVSVTIPSCIEDGEYLLRVEHIALHSASSVGGAQFYIACAQLSVTGGSGTLNTGSLVSLPGAYKATDPGILFQLYWPIPTEYINPGPAPVSC

SEQ ID NO: 69 - DNA, 696 bp, Chrysosporium lucknowense
atgaagctcacctcgtccctcgctgtcctggccgctgccggcgcccaggctcactataccttccctagggccggcactggtggttcgctctctggcgagtgggaggtggtccgcatgaccgagaaccattactcgcacggcccggtcaccgatgtcaccagccccgagatgacctgctatcagtccggcgtgcagggtgcgccccagaccgtccaggtcaaggcgggctcccaattcaccttcagcgtggatccctccatcggccaccccggccctctccagttctacatggctaaggtgccgtcgggccagacggccgccacctttgacggcacgggagccgtgtggttcaagatctaccaagacggcccgaacggcctcggcaccgacagcattacctggcccagcgccggcaaaaccgaggtctcggtcaccatccccagctgcatcgaggatggcgagtacctgctccgggtcgagcacatcgcgctccacagcgccagcagcgtgggcggcgcccagttctacatcgcctgcgcccagctctccgtcaccggcggctccggcaccctcaacacgggctcgctcgtctccctgcccggcgcctacaaggccaccgacccgggcatcctcttccagctctactggcccatcccgaccgagtacatcaaccccggcccggcccccgtctcttgc

SEQ ID NO: 70 - DNA, 1745 bp, Chrysosporium lucknowense
  CDS (166)..(287)
  CDS (423)..(478)
  CDS (732)..(1160)
  CDS (1356)..(1645)
gtatatatggacccgagactgtgcaaaaccacgtctgttccttctgtgagaaacaagatagtattttatggcggcttttttttgttttccttagcgttctttggagacgcccttgtgttttgttttgatcctccgagtctttacaagccaactttactaccaacgatggtcactgtcagcagccttgttgccgccgcgggcgtggtcctcctggctggccaggaggtctttgctgtgcagctcaccagggtcgattaccctaacaatgccacgtccagggcggagatgtgagtttcaaaaaaaaaaaaaaaaaaaaaatttttttgatgggaaggagagagatattgtgtggcgttttgtgacggtgactgacgcgggtgggtgacgatgatgttgatgttgatgatgatgatgttacgcaggtacatctatgttcccgacaacgttgtcgagtcgccgccgctggtagtggttgtccgtaagttttgtttctctttcaaaaaaaaaaaatatttcgggtttccggtgccccatcattccccttgccactacgaagcatatccgtgccgagaaggcagtttcccgggtcaccatcagtgccccagtgccctcatccctcccaacctcatcccatatatatatatatatatatatatatgttgtatgaaaatatatatggctaaccagacatgaaacacctcccccatccggccttggctccccacgttcagactcatgtcagtcctcggcccaggcgtacttccaaaacgcggcgatcccgtggcggcaggggtcggacaacaaggggtacatcacgctgtggccgtcgtcagcgaacccgggggacgtgctgggacgtgtcgtcgccgcggtcgctggagcgcgggggcgggggcgggggcgactcgcaggccatcgccgacatgatcctgcacgcggtggccgagtacggggcggacgcggcgcgcgtctacctgacgggcggcagctccggcgccatgatgggcaacgttcatggccgcgacgtacccggacctgctgcgggccgtcagcgtctactcgggcgtgccggccggctgcttcgtcagctcggccggccaggtggccgcgtggaacaacacgtgcagcggcggccggagcagggccagcccggagcagtggtgcgtcattccaaccccctcccctccctcccctttctcccatttttttgttctgtttcccatgttcctttttctcttttttctttcccctccccaaccccccccccttttccttttttaccccctttcttttccccactcgttgactggtgatgggccgggtgattgattgattgtttgatggtggtgttaggggcaacgtggtgagggacatgtatcccgggtatgaaggcccccggcccaaaatgcagatctggcacgggagtgccgacagcacgctcgcgccggccaactacgaggagacgatcaagcagtggacgaacgtgtttggggtgagccaggagccgacaaactcggtcgagaactatccggcgcccaactaccggacggatgactacggggagaacgttcagggcatctttgcgaacggcgtcgggcatagcgtgccggcgaacctgacggccagcgaggcctggttcgggctgtgagtcgggtcggggtggtgtattatagcggctggggcagtttgggtgttgttgtgtgtatttgacatcgtccaactgcttactgccgaccctggaggca

SEQ ID NO: 71 - protein, 299 aa, Chrysosporium lucknowense
MVTVSSLVAAAGVVLLAGQEVFAVQLTRVDYPNNATSRAEMYIYVPDNVVESPPLVVVVHSCQSSAQAYFQNAAIPWRQGSDNKGYITLWPSSANPGDVLGRVVAAVAGARGRGRGRLAGHRRHDPARGGRVRGGRGARLPDGRQLRRHDGQRSWPRRTRTCCGPSASTRACRPAASSARPARWPRGTTRAAAAGAGPARSSGNVVRDMYPGYEGPRPKMQIWHGSADSTLAPANYEETIKQWTNVFGVSQEPTNSVENYPAPNYRTDDYGENVQGIFANGVGHSVPANLTASEAWFGL

SEQ ID NO: 72 - DNA, 897 bp, Chrysosporium lucknowense
atggtcactgtcagcagccttgttgccgccgcgggcgtggtcctcctggctggccaggaggtctttgctgtgcagctcaccagggtcgattaccctaacaatgccacgtccagggcggagatgtacatctatgttcccgacaacgttgtcgagtcgccgccgctggtagtggttgtccactcatgtcagtcctcggcccaggcgtacttccaaaacgcggcgatcccgtggcggcaggggtcggacaacaaggggtacatcacgctgtggccgtcgtcagcgaacccgggggacgtgctgggacgtgtcgtcgccgcggtcgctggagcgcgggggcgggggcgggggcgactcgcaggccatcgccgacatgatcctgcacgcggtggccgagtacggggcggacgcggcgcgcgtctacctgacgggcggcagctccggcgccatgatgggcaacgttcatggccgcgacgtacccggacctgctgcgggccgtcagcgtctactcgggcgtgccggccggctgcttcgtcagctcggccggccaggtggccgcgtggaacaacacgtgcagcggcggccggagcagggccagcccggagcagtggcaacgtggtgagggacatgtatcccgggtatgaaggcccccggcccaaaatgcagatctggcacgggagtgccgacagcacgctcgcgccggccaactacgaggagacgatcaagcagtggacgaacgtgtttggggtgagccaggagccgacaaactcggtcgagaactatccggcgcccaactaccggacggatgactacggggagaacgttcagggcatctttgcgaacggcgtcgggcatagcgtgccggcgaacctgacggccagcgaggcctggttcgggctg

SEQ ID NO: 73 - DNA, 1808 bp, Chrysosporium lucknowense
  CDS (201)..(346)
  CDS (427)..(602)
  CDS (677)..(783)
  CDS (861)..(979)
  CDS (1077)..(1253)
  CDS (1327)..(1434)
  CDS (1584)..(1740)
cgttaaaagaagctcggcggtgtcccttggaagcgctcccaatataatctcgatgagtcctgtgaggagaggaggaatcgaactaattagtcgcttggtagcctttgcgctcgctttcttgatttccattcacccatagagaatcccgttcccatagtacacgggcgccttttggctgatcgccttgaataccttcgatgatgaagctacttgctcttgcttcgctcctggcactgacagcggcctcgccgaccccgactcagcccgagtccggaacgccccgcctggccaaaagggcggggatctcagatgctgccgacattggttacgccacgcttaacggggggtgagattataaatccgttaaccaagccagagaaacagcagtttgctaattaaccggcctttattattggatattaatagcacgaagggaggtgcaggcggcaccgtgacaacggtatcaacactggcccagttcacagccgccgtcaacgagaagaacagcgacccggccattgttgtcgtcaaaggcatcattagcggaaacgagaaggtgcgggttggcagcaacaagagcatcatcggcctgcctggatcaggtgagtcttggcacacgctggccccgtcttgctcgaggagaaggggcctgaacttaccacgagcgagtgcccaggcttcaagggtgttggcctccatttccggcgccagagcaacctgatcttgcgcaacatcgtctcttccttcgtggaggccgacaatggagacgggctgaagattgaggtaggtaattacctcgcaattactaattacccgttcctttccgaacttcgcttctctctgacatcctggatgtgcaggaaagcaccaacgtctgggtcgaccactgcgagttcttctcgaccctcgacgtcgacaaggattactacgacggcctggtggactcgtcacacggctccgacttcatcaccatttcccagtgagacatgcgcgcccccccccccctctctttgtgccgtctccgtctccgtctccatccagaacttaggcgaggttgacttaattacgtctgccagcacgtacttccacgaccattggaaggcatcccttgccgggcacagcgacagcaacggtagccaagaccggggcaagctccatctgacgtacgccaacaactactggaagaacatcaactcgcgcggaccgctgctccgcttcgggacgggacacatctacaactcgtactttgaaaagtgagtatcccgcgtcaacaagaaaagagtagaaaaaaaaaggctgaccggagactgtgacttgactaattagcatgagcacggcaatcaacacacggatgggcgcccaggtgctggttcagagcaacgtcttcaggaacgtgacggtccccgtcaccagccgcgactcggacgaagttgggtaagtaattatggcgggcgtcgccgccgttgctttttttctctctctcgagtcgagtggacaacgaatgcatttgaaagagaaggggggaaaagaaggaaatgctgacatgctcgtgccccccccccccttttcctttcgcaccccagatacgcgacggtcatcgacacggacctcggcggcggtctcaacgatgcgcccgagggcaacatggtgccggactcggtcgggtacgagtactcgctgctcggctccggcgcggtggcggggaaggttcccggcgaggcgggagccattctgaccttctgagtcggatccggtgtcccgggttgaagtcgaaggttggggaaaagcatgggctggcgctgtgccca

SEQ ID NO: 74 - protein, 330 aa, Chrysosporium lucknowense
MKLLALASLLALTAASPTPTQPESGTPRLAKRAGISDAADIGYATLNGGTKGGAGGTVTTVSTLAQFTAAVNEKNSDPAIVVVKGIISGNEKVRVGSNKSIIGLPGSGFKGVGLHFRRQSNLILRNIVSSFVEADNGDGLKIEESTNVWVDHCEFFSTLDVDKDYYDGLVDSSHGSDFITISHTYFHDHWKASLAGHSDSNGSQDRGKLHLTYANNYWKNINSRGPLLRFGTGHIYNSYFENMSTAINTRMGAQVLVQSNVFRNVTVPVTSRDSDEVGYATVIDTDLGGGLNDAPEGNMVPDSVGYEYSLLGSGAVAGKVPGEAGAILTF

SEQ ID NO: 75 - DNA, 990 bp, Chrysosporium lucknowense
atgaagctacttgctcttgcttcgctcctggcactgacagcggcctcgccgaccccgactcagcccgagtccggaacgccccgcctggccaaaagggcggggatctcagatgctgccgacattggttacgccacgcttaacgggggcacgaagggaggtgcaggcggcaccgtgacaacggtatcaacactggcccagttcacagccgccgtcaacgagaagaacagcgacccggccattgttgtcgtcaaaggcatcattagcggaaacgagaaggtgcgggttggcagcaacaagagcatcatcggcctgcctggatcaggcttcaagggtgttggcctccatttccggcgccagagcaacctgatcttgcgcaacatcgtctcttccttcgtggaggccgacaatggagacgggctgaagattgaggaaagcaccaacgtctgggtcgaccactgcgagttcttctcgaccctcgacgtcgacaaggattactacgacggcctggtggactcgtcacacggctccgacttcatcaccatttcccacacgtacttccacgaccattggaaggcatcccttgccgggcacagcgacagcaacggtagccaagaccggggcaagctccatctgacgtacgccaacaactactggaagaacatcaactcgcgcggaccgctgctccgcttcgggacgggacacatctacaactcgtactttgaaaacatgagcacggcaatcaacacacggatgggcgcccaggtgctggttcagagcaacgtcttcaggaacgtgacggtccccgtcaccagccgcgactcggacgaagttggatacgcgacggtcatcgacacggacctcggcggcggtctcaacgatgcgcccgagggcaacatggtgccggactcggtcgggtacgagtactcgctgctcggctccggcgcggtggcggggaaggttcccggcgaggcgggagccattctgaccttc

SEQ ID NO: 76 - DNA, 1718 bp, Chrysosporium lucknowense
  CDS (80)..(228)
  CDS (311)..(480)
  CDS (574)..(812)
  CDS (950)..(1092)
  CDS (1223)..(1499)
acagtgaagagaagagaaaaagaaaaccaaaaaaaaaaaaaaaaaagaaacaaaaatttcaagacacccgacgcccaacatgaagtttctgttgaccacaaccatcgccgccctggccggccttgttgccgcctcgcccacacccacagtcaacatcggcggacagctctacaagcgtgccagcccgaacgacgtttgcgacatcggctacgcctccaccaacggcgggtgagttttgactcccccatatctccttggtgccccggatctgctgatgctaaacctttggtttgttacaacatcacaacagcacaactggaggtgcgggcggaacgaccacaaccgtcaccagcttcgccgagttcagtgccgccgccaagggtgacgacaagaagatcatcattgtcgacggcagcatcagcggctctggctccgtcaagatcggcgctaacacgagcgttctcgggaaggccggtgcttgtacgtcggccttttctgttcttttttctctcgttatattataaacacaaaatgagcccggcaatagactagttactaacagaacccgttcagccctcaccggcatcaaccttaccatcaagggcgtcaagaacgtcatcgtccgcaacttgaagctcagcaaggtggtgggcggcgactgcatcaccgtccaggaagccaccaacgtctggctcgaccatctcgacctgagcggcgacctgaacgtcgacaaggactactacgacggtctgatcgacatcacccacgccgccgactgggtcaccgtctctaacacccacttccacgaccatgtaattcccctcgcccacgttttctctctttattttcttctctctttgctttcttcctcgaataagaagaagatgaaaaagaagaagaagatcacgttgctgaccaagtcatcacttcgctcctttctcaactgcagtggaaggcttcgctggtcggccactctgacagcaacgccgacgaggacacgggcaagctccacgtcacgtacgccaacaacaggtggaccaacatcagcagccgcacgccctcgatccgcttcggcaccggtcacatcttcaagtaagccagatgcgattttcgtttttttttctttcccaaatcaaaaaccgtaagaaaaaaaaaaacaaatttgcaagaactggctgaatttaacacgaccgcgcctcctcctcctcctcctcctccccagcaactactacgacaccatcacgacctcgggcgtcaacacgcgcatgggcgccgtcgtgctggtcgagtcgagcgccttcgtcaacgccaagcgcgccatcacctcgctcgactcggacatcgacggctccgccgccgtcgtcgacgtcgacctcggcggctccaccaacgacgcccccgtcgccaacgccgccccttccatcccctaccggtactccgtcgtcggctccgccaacgtccgcgacgccaccgccaacagcggcgccactctcgccttctaagccgcctctttcttttttttctcaccctttgtttttcgtatctccgtgatagttttttttttcgtctggcgattttatgtggtgtgatgccgcatgattcactctatcgagggagaaagagacgaggagcgctcggccggaaggttcgaggcgtgatcaatcatgagccgctggttttgatgacgaacggcaaagatgtaccgagcagccaaaaaa

SEQ ID NO: 77 - protein, 326 aa, Chrysosporium lucknowense
MKFLLTTTIAALAGLVAASPTPTVNIGGQLYKRASPNDVCDIGYASTNGGTTGGAGGTTTTVTSFAEFSAAAKGDDKKIIIVDGSISGSGSVKIGANTSVLGKAGASLTGINLTIKGVKNVIVRNLKLSKVVGGDCITVQEATNVWLDHLDLSGDLNVDKDYYDGLIDITHAADWVTVSNTHFHDHWKASLVGHSDSNADEDTGKLHVTYANNRWTNISSRTPSIRFGTGHIFNNYYDTITTSGVNTRMGAVVLVESSAFVNAKRAITSLDSDIDGSAAVVDVDLGGSTNDAPVANAAPSIPYRYSVVGSANVRDATANSGATLAF

SEQ ID NO: 78 - DNA, 978 bp, Chrysosporium lucknowense
atgaagtttctgttgaccacaaccatcgccgccctggccggccttgttgccgcctcgcccacacccacagtcaacatcggcggacagctctacaagcgtgccagcccgaacgacgtttgcgacatcggctacgcctccaccaacggcggcacaactggaggtgcgggcggaacgaccacaaccgtcaccagcttcgccgagttcagtgccgccgccaagggtgacgacaagaagatcatcattgtcgacggcagcatcagcggctctggctccgtcaagatcggcgctaacacgagcgttctcgggaaggccggtgcttccctcaccggcatcaaccttaccatcaagggcgtcaagaacgtcatcgtccgcaacttgaagctcagcaaggtggtgggcggcgactgcatcaccgtccaggaagccaccaacgtctggctcgaccatctcgacctgagcggcgacctgaacgtcgacaaggactactacgacggtctgatcgacatcacccacgccgccgactgggtcaccgtctctaacacccacttccacgaccattggaaggcttcgctggtcggccactctgacagcaacgccgacgaggacacgggcaagctccacgtcacgtacgccaacaacaggtggaccaacatcagcagccgcacgccctcgatccgcttcggcaccggtcacatcttcaacaactactacgacaccatcacgacctcgggcgtcaacacgcgcatgggcgccgtcgtgctggtcgagtcgagcgccttcgtcaacgccaagcgcgccatcacctcgctcgactcggacatcgacggctccgccgccgtcgtcgacgtcgacctcggcggctccaccaacgacgcccccgtcgccaacgccgccccttccatcccctaccggtactccgtcgtcggctccgccaacgtccgcgacgccaccgccaacagcggcgccactctcgccttc

SEQ ID NO: 79 - DNA, 1337 bp, Chrysosporium lucknowense
  CDS (95)..(562)
  CDS (660)..(1065)
  CDS (1140)..(1273)
acattaagctgcatggaaccccgtgttccggtcgcaaccatgacctgcagctattagctcttcatcatccaccccaaatacccggatatccaacatgcggttcagtttcctcactgtcgcctcggccctcgctccatttaccgcggcgttccccttcgggagctttggcctcgcgtcgtgggatgtcgagggctttgccaaagacaatcccattggcgtcaccactggcggcgagggcgggtcaacggtgaccgtggataacgcggccgacttcaaggcagctgttgcgggagacgagcccaagacggtcctcgtcaagggcgagatcaacctgccgtcccggccaaagattggctccaacaagtccgtcattggtgtcggacgcaccgcccacatcaccggcagcggcctcgacgtgttcaactcgaccaacgtcatcatccgcaacctcaagatcagcttcatcgaggacaacgattgcatcaccatccggaactccaccagggtctgggtggaccacaacgagttcgcttccgacatcacgaaaggacccgacgcctacgtgagtctcttgcgctctacaatctcctaattaattagaaagtgcacacaacgggattcgctgagaagagattgtctttcttgaatatgttacgcaggacggccaagtcgacatcatccgcggttccgactggatcacggtatcgtggaactacttccacgaccactggaagtcgtccctggtcggcaacgacgccaccttccgcgacatcgactttggccacctgcacgtaacctaccaccacaactactggcgcaacgagggtacccgcggcccggccggccgcttcgggcaccagcacgtctacaacaacctctacgtcgacttcctctaccaggccatccactcccgctccgacaaccaggtcctcgtcgagggcaacgtcttccgcggcaagacccgcgaggccctgagcacctacggcctggtgatcccggacgactcgcccaacacttgcacctgcggcgacgaagagctggacggctacgccaacttgggcgccagtaagtctccctcgtggctgttaaaatgaaggaagggtggggtgtgtgtaatgtgctgacatgatgacgcgcagaaaacgattggggcaaggcgacggtcaacatcacgcaggtcggcaactttcgaaaggcaccgtacaagttcaagttgactcccctgccgttggttgagccgattgtcaagctcggggccggtgtgggcaagatctgatgacctcgagattcgtgtgtgagccgatgttgcttttttcttcagcacggggttgtcgaaa

SEQ ID NO: 80 - protein, 336 aa, Chrysosporium lucknowense
MRFSFLTVASALAPFTAAFPFGSFGLASWDVEGFAKDNPIGVTTGGEGGSTVTVDNAADFKAAVAGDEPKTVLVKGEINLPSRPKIGSNKSVIGVGRTAHITGSGLDVFNSTNVIIRNLKISFIEDNDCITIRNSTRVWVDHNEFASDITKGPDAYDGQVDIIRGSDWITVSWNYFHDHWKSSLVGNDATFRDIDFGHLHVTYHHNYWRNEGTRGPAGRFGHQHVYNNLYVDFLYQAIHSRSDNQVLVEGNVFRGKTREALSTYGLVIPDDSPNTCTCGDEELDGYANLGAKNDWGKATVNITQVGNFRKAPYKFKLTPLPLVEPIVKLGAGVGKI

SEQ ID NO: 81 - DNA, 1008 bp, Chrysosporium lucknowense
atgcggttcagtttcctcactgtcgcctcggccctcgctccatttaccgcggcgttccccttcgggagctttggcctcgcgtcgtgggatgtcgagggctttgccaaagacaatcccattggcgtcaccactggcggcgagggcgggtcaacggtgaccgtggataacgcggccgacttcaaggcagctgttgcgggagacgagcccaagacggtcctcgtcaagggcgagatcaacctgccgtcccggccaaagattggctccaacaagtccgtcattggtgtcggacgcaccgcccacatcaccggcagcggcctcgacgtgttcaactcgaccaacgtcatcatccgcaacctcaagatcagcttcatcgaggacaacgattgcatcaccatccggaactccaccagggtctgggtggaccacaacgagttcgcttccgacatcacgaaaggacccgacgcctacgacggccaagtcgacatcatccgcggttccgactggatcacggtatcgtggaactacttccacgaccactggaagtcgtccctggtcggcaacgacgccaccttccgcgacatcgactttggccacctgcacgtaacctaccaccacaactactggcgcaacgagggtacccgcggcccggccggccgcttcgggcaccagcacgtctacaacaacctctacgtcgacttcctctaccaggccatccactcccgctccgacaaccaggtcctcgtcgagggcaacgtcttccgcggcaagacccgcgaggccctgagcacctacggcctggtgatcccggacgactcgcccaacacttgcacctgcggcgacgaagagctggacggctacgccaacttgggcgccaaaaacgattggggcaaggcgacggtcaacatcacgcaggtcggcaactttcgaaaggcaccgtacaagttcaagttgactcccctgccgttggttgagccgattgtcaagctcggggccggtgtgggcaagatc

SEQ ID NO: 82 - DNA, 1455 bp, Chrysosporium lucknowense
  CDS (161)..(512)
  CDS (596)..(673)
  CDS (736)..(1238)
aaatataaggacggagcatcatgaaatgcaatagatcccagatctagcttggcaaatcatacataagagggcaatcatcagctttggcgcggtgaagaggatcagcagcgtcagcaaggttttcacgtgcttccacccgataattaagaaacgcccggaaatgaagttctctatctctctcgttctcccgctccttcggcttgcgggcctcgcctgggctgggtgccaggacaacgcggacggttttgctgcgctgaacggcggtaccactggcggcaacggtggcactgtagtgactgtcaacaatcaagcagacctcgagaagtacgccaaagcgagtggaaagtatgtgatcaaagtgtcgggcaagatcaacatctcgcccaaagggaccgaggttgatgtagccaacgacaagaccatcgtcggtattggcgcgactgctcagatttctgggggaggcttccggatcatcaacaggcgcaacgttattattcgcaacctgcgaattggtgggtgcagtttgcattgcatcacttgcaacgagttcctgcggttatacggatgctgatcattctgtaattaccttccttaggcaacaccgatggtggcgaggaactggactgggacggaatccaggttgatacctctaccaacatctggatcgaccactgtgagtttcgcccgcccgtgttcttttcgcttaattactggagtgtgttgacggtacatcaggcatcttcgaaaccatcggcgacggaggcatcgacctgcgcaaggattcggactactggaccgtatccaactcgtggatcaagggcgtcaacaaggcattcggtatcggctggaccgacaacgtcgtgaccaaggggacgatccaccacgtctacttcgacggaacaacgcagcggaatcccagcgcggacaacatgctttacgcccacatgtacaacaattacctgcggggctgcaagagttacggccactatgcccgcggtgcgaccaacgcgcgcatcgagaacgtatattttgaggactgcaagaatccgctcaccgcagattcggaggccacgctgacggctatcggcaacatttacgacggcaccagcggcaccattgccaaagacatcggcgtctcgttcgacccggccaacttctattcgtacaagctcaacgctaccgccgacgtgcctagcatcgttctcgcaaacgctggtcccaaggctgatgtatgcacctaggctgaggcgcctgccaagtttggaggggaactacgacagggtgacttctggatcaggtctgtttttagcaacgctactgggtctaagtcaggctcggagtctcccggagtttagtactcctgtcttaacggaagcaggagatgacagatgggaaatctagggactagtcgggaagccgagtcagccattggccggtgagcggttggtggcatta

SEQ ID NO: 83 - protein, 311 aa, Chrysosporium lucknowense
MKFSISLVLPLLRLAGLAWAGCQDNADGFAALNGGTTGGNGGTVVTVNNQADLEKYAKASGKYVIKVSGKINISPKGTEVDVANDKTIVGIGATAQISGGGFRIINRRNVIIRNLRIGNTDGGEELDWDGIQVDTSTNIWIDHCIFETIGDGGIDLRKDSDYWTVSNSWIKGVNKAFGIGWTDNVVTKGTIHHVYFDGTTQRNPSADNMLYAHMYNNYLRGCKSYGHYARGATNARIENVYFEDCKNPLTADSEATLTAIGNIYDGTSGTIAKDIGVSFDPANFYSYKLNATADVPSIVLANAGPKADVCT

SEQ ID NO: 84 - DNA, 933 bp, Chrysosporium lucknowense
atgaagttctctatctctctcgttctcccgctccttcggcttgcgggcctcgcctgggctgggtgccaggacaacgcggacggttttgctgcgctgaacggcggtaccactggcggcaacggtggcactgtagtgactgtcaacaatcaagcagacctcgagaagtacgccaaagcgagtggaaagtatgtgatcaaagtgtcgggcaagatcaacatctcgcccaaagggaccgaggttgatgtagccaacgacaagaccatcgtcggtattggcgcgactgctcagatttctgggggaggcttccggatcatcaacaggcgcaacgttattattcgcaacctgcgaattggcaacaccgatggtggcgaggaactggactgggacggaatccaggttgatacctctaccaacatctggatcgaccactgcatcttcgaaaccatcggcgacggaggcatcgacctgcgcaaggattcggactactggaccgtatccaactcgtggatcaagggcgtcaacaaggcattcggtatcggctggaccgacaacgtcgtgaccaaggggacgatccaccacgtctacttcgacggaacaacgcagcggaatcccagcgcggacaacatgctttacgcccacatgtacaacaattacctgcggggctgcaagagttacggccactatgcccgcggtgcgaccaacgcgcgcatcgagaacgtatattttgaggactgcaagaatccgctcaccgcagattcggaggccacgctgacggctatcggcaacatttacgacggcaccagcggcaccattgccaaagacatcggcgtctcgttcgacccggccaacttctattcgtacaagctcaacgctaccgccgacgtgcctagcatcgttctcgcaaacgctggtcccaaggctgatgtatgcacc

SEQ ID NO: 85 - DNA, 1460 bp, Chrysosporium lucknowense
  CDS (164)..(344)
  CDS (459)..(538)
  CDS (620)..(669)
  CDS (743)..(787)
  CDS (907)..(1300)
gtataaaaaggatggactccgacctcagtctcttgacgcgaaccaactcagtccatcaacagacaacttgagtcaacaaccatcccaggttgcctattaattaattattcgctcaacagaccatcgcattcacacatccacttcaaccatccaacatccaacgatgcatcgctacgccttcctcgccctgctcccggccgtcctcgccaaggtgccccttgtggcccgcgccggagtcacgaccacgctgccggccagcgcgggcgccactgccacgtcggcgcccatcaccgtcaaagccgggcagacgtacgacggcaagatgaagaactttgatcgctcccgtacgtgcgcacgtttccttgccgcctcgccgcgcctcggttagggttggcgaaagagaagaagaaggaaagaagaagaaaggggtgtgtgtgcagatggctgacgtccagcagcgagagtctgtgctgagcagacggagacgggtgaggatgacgccatgttcattctcgaggacggtgccactctctccaacgtatgtttttttttttttttttttttgagtttagaatgattacatgtctagaaaggaggtaatagctaaccatgcccgcaggtcatcattggtcccaaccaggcggagggtgtccattgcaggggcacttggtaagtattaaccactgcggcgaagccagcgtccgatcaaacagcatctagaaactaatctcgtgtgtgacagcaccctgatcaacgtctggttccaagatgtctgcgaagatgctatgtacgtgtcatcccccctattagcttcctggctctctcacggccaagagcaaagaagtattaccatcctctttatcccggcaagctactaacgtactctctttctctctctctgtgcagcaccctcaagcagtcgagcggcacgtcccggatcatcggcggcggcgccttccatgccgacgacaagattgtgcagttcaacgggttcggcacggtggagatcagcgacttcttcgcgagcgactacggcaaggtggtgcgcagctgcggcaactgcaaggacaacggcggggcgcggcacatcgtcatcgacaacgtcgtcgccgtcgacggcggcgtcctctgcggcatcaacaccaactacggcgacacctgcaagatttccaacagctgccaggacgacggcaagagctgcgaccgcttcaccggcaacaacagcggcaaggagcccaccaagatcggcagcggtcccgacggccagttctgcaccgtcaccaacctgtccaagagctgctaaatcactggccacaactggcggtgtttatagccatttcttgaggagagcctggtatgctggccgcgggcggtgccgggctgcaatgtacatagttgatttcttggttgcacatactttcctaagtcacatatttttgagatttgagtacctagttgga

SEQ ID NO: 86 - protein, 250 aa, Chrysosporium lucknowense
MHRYAFLALLPAVLAKVPLVARAGVTTTLPASAGATATSAPITVKAGQTYDGKMKNFDRSPRVCAEQTETGEDDAMFILEDGATLSNVIIGPNQAEGVHCRGTCTLINVWFQDVCEDAITLKQSSGTSRIIGGGAFHADDKIVQFNGFGTVEISDFFASDYGKVVRSCGNCKDNGGARHIVIDNVVAVDGGVLCGINTNYGDTCKISNSCQDDGKSCDRFTGNNSGKEPTKIGSGPDGQFCTVTNLSKSC

SEQ ID NO: 87 - DNA, 750 bp, Chrysosporium lucknowense
atgcatcgctacgccttcctcgccctgctcccggccgtcctcgccaaggtgccccttgtggcccgcgccggagtcacgaccacgctgccggccagcgcgggcgccactgccacgtcggcgcccatcaccgtcaaagccgggcagacgtacgacggcaagatgaagaactttgatcgctccccgagagtctgtgctgagcagacggagacgggtgaggatgacgccatgttcattctcgaggacggtgccactctctccaacgtcatcattggtcccaaccaggcggagggtgtccattgcaggggcacttgcaccctgatcaacgtctggttccaagatgtctgcgaagatgctatcaccctcaagcagtcgagcggcacgtcccggatcatcggcggcggcgccttccatgccgacgacaagattgtgcagttcaacgggttcggcacggtggagatcagcgacttcttcgcgagcgactacggcaaggtggtgcgcagctgcggcaactgcaaggacaacggcggggcgcggcacatcgtcatcgacaacgtcgtcgccgtcgacggcggcgtcctctgcggcatcaacaccaactacggcgacacctgcaagatttccaacagctgccaggacgacggcaagagctgcgaccgcttcaccggcaacaacagcggcaaggagcccaccaagatcggcagcggtcccgacggccagttctgcaccgtcaccaacctgtccaagagctgc

SEQ ID NO: 88 - DNA, 2554 bp, Chrysosporium lucknowense
  CDS (166)..(1752)
  CDS (2182)..(2247)
agtgcatcctcctcattagttagcgggccaagataacgttaatatacgccattcctgagcaaagcatttctggtcaagatggcgtttcccccaggccaagcccgtctcgtgtagatcactgatctttgatacttccgtatctgggcttgatctgaggactctaacatggaactccgatctgtcgtccgtctcttggtcctgtcggcctccgtcttcgcgccgggggtcctcagtgcgttcgggtacacctcgtccggcaacaactatgtcatcgatgccggctccgccaacccgctggtcttctcggtgagcaagtcgagctgcgacatcaactcgatcaagtatcgcggcaccgagctccagtattccaacaccggaacccacatcggttccgggctcgggtcggccaccgtctcggtcagccagatcagcggatcgtcccggtacatcaaggtgacatgtgtgacgtcgaccctgacgcactacattgtggtccgggagggtgagagcatcatctacatggccacctacatcaccgccgagccgtcggttggcgagctgcgcttcatcgcccgtctgctgcccgacaaactgcccaacgagtacccgtacggcgaggtctccaacacgagcggcgccagcgcgacagtcgaggggtccgatgtcttcatcgtcaacgggcagacgaggtccaagttttactcgtcgacacgcttcatcgacgaggactcgcactgcgtgtacggcggcagcgacctgatccacgtctgcatcatgacgccccagcaggagtcgtcgtccggcggcccgttcttccgcgacatcgactcgaacaacgcgggggattcgaccaacctgtacaactacatgaacagcggccacgtgcagaccgaggcgttccgcatggggcttcacggaccgtacgccatgcagttctcgcgctccggtatccccagcgtgaagaacctggacgtctcgtggttcggcgaggtctcggtcaccgggtacgtgcccgcctccggccgcgggaccgtgcaggggaccgcgagcggcgtgcagagcgggatgcagggggtggtgcactggtacaacagcaatgcgcagtactgggccaagacgtcatccagcggcgccttcacctcgccgctgatgaagcccggcacgtacaccatggtactttaccagaccgagttcaagattgccacgaccaccgtcaccgtgtccgcgggccagacgaccaggcaggacattgccggcaacttcaacacgtcccgcaacacgctcttccagatcggcgagtacgacggccagccgaccgggttccgcaacgccgacaagttcctccgcatgcacccgagcgacagccgcatggacagctggggccccctgacctacacggtgggcagctcgacgctgtccgacttccccatggccgtcttcaagtcggtgaacaacccggtgaccatcaagttcaacctggccagcgccccgggggccgccaccctgcgcatcgccacgaccctcagcttcgcggggagccgcccccaggcgacggtcaacggctggtccggccccgtcccggccgccccgaccaagatcgacagccgcggcgtgacgcgcggcgcctatcgcgggtacggcgagatctataccgtcaacatccccgccggcacgctcgtcgctggcatcaacaccatcacaatcagttccgtctctggcagcgatggagatgccttcctgagccccaactttgtaagtcatggcccctttttctcctcccaccctgacccacccccccactttctttttacgcgtcatccggtgagcagtccctaacaagtccccactcggggcaattcttctcttacagatcttcgatgccgttgaactctacacagcttgaccttagcttgcatgggtattttgtctatgcctggtgtggcaaagcagagtggtgttgcggctttttttattattttctaaagaacaatttaattattattattattattttccctattgcttcggtgtcggacacccgaggcgactcttcatatacgaggggcctgccagactagaactgtgtgactatggtaccttacctatgcggacgacccgaccccacaccttctgggtaccgtagtatttaacttgtctcaactgccaatatggtcacttcagtcttggacagccaaggtcttggatcttctcgactgtgccccccaagtgcttgccggcttgaagctttgacggactcgtattccatgattaatgccagtgactcatgacaacctaggtacagatccgggattcatgtgatctgttctaattatcagctatctatgttacgactggaacatgtgtgtaaatatgctggttcctggttcggtgttcttattatgtgtgctcgacgaattacactctcctgggagagggggagaggggtagggcgttgccagctgccattttttacatttcacgatgagtgtacaggttggtaccctgagtgcatgagcttaactcagtcctccctccatttcctagggccaaaaaa

SEQ ID NO: 89 - protein, 551 aa, Chrysosporium lucknowense
MELRSVVRLLVLSASVFAPGVLSAFGYTSSGNNYVIDAGSANPLVFSVSKSSCDINSIKYRGTELQYSNTGTHIGSGLGSATVSVSQISGSSRYIKVTCVTSTLTHYIVVREGESIIYMATYITAEPSVGELRFIARLLPDKLPNEYPYGEVSNTSGASATVEGSDVFIVNGQTRSKFYSSTRFIDEDSHCVYGGSDLIHVCIMTPQQESSSGGPFFRDIDSNNAGDSTNLYNYMNSGHVQTEAFRMGLHGPYAMQFSRSGIPSVKNLDVSWFGEVSVTGYVPASGRGTVQGTASGVQSGMQGVVHWYNSNAQYWAKTSSSGAFTSPLMKPGTYTMVLYQTEFKIATTTVTVSAGQTTRQDIAGNFNTSRNTLFQIGEYDGQPTGFRNADKFLRMHPSDSRMDSWGPLTYTVGSSTLSDFPMAVFKSVNNPVTIKFNLASAPGAATLRIATTLSFAGSRPQATVNGWSGPVPAAPTKIDSRGVTRGAYRGYGEIYTVNIPAGTLVAGINTITISSVSGSDGDAFLSPNFSWTAKVLDLLDCAPQVLAGLKL

SEQ ID NO: 90 - DNA, 1653 bp, Chrysosporium lucknowense
atggaactccgatctgtcgtccgtctcttggtcctgtcggcctccgtcttcgcgccgggggtcctcagtgcgttcgggtacacctcgtccggcaacaactatgtcatcgatgccggctccgccaacccgctggtcttctcggtgagcaagtcgagctgcgacatcaactcgatcaagtatcgcggcaccgagctccagtattccaacaccggaacccacatcggttccgggctcgggtcggccaccgtctcggtcagccagatcagcggatcgtcccggtacatcaaggtgacatgtgtgacgtcgaccctgacgcactacattgtggtccgggagggtgagagcatcatctacatggccacctacatcaccgccgagccgtcggttggcgagctgcgcttcatcgcccgtctgctgcccgacaaactgcccaacgagtacccgtacggcgaggtctccaacacgagcggcgccagcgcgacagtcgaggggtccgatgtcttcatcgtcaacgggcagacgaggtccaagttttactcgtcgacacgcttcatcgacgaggactcgcactgcgtgtacggcggcagcgacctgatccacgtctgcatcatgacgccccagcaggagtcgtcgtccggcggcccgttcttccgcgacatcgactcgaacaacgcgggggattcgaccaacctgtacaactacatgaacagcggccacgtgcagaccgaggcgttccgcatggggcttcacggaccgtacgccatgcagttctcgcgctccggtatccccagcgtgaagaacctggacgtctcgtggttcggcgaggtctcggtcaccgggtacgtgcccgcctccggccgcgggaccgtgcaggggaccgcgagcggcgtgcagagcgggatgcagggggtggtgcactggtacaacagcaatgcgcagtactgggccaagacgtcatccagcggcgccttcacctcgccgctgatgaagcccggcacgtacaccatggtactttaccagaccgagttcaagattgccacgaccaccgtcaccgtgtccgcgggccagacgaccaggcaggacattgccggcaacttcaacacgtcccgcaacacgctcttccagatcggcgagtacgacggccagccgaccgggttccgcaacgccgacaagttcctccgcatgcacccgagcgacagccgcatggacagctggggccccctgacctacacggtgggcagctcgacgctgtccgacttccccatggccgtcttcaagtcggtgaacaacccggtgaccatcaagttcaacctggccagcgccccgggggccgccaccctgcgcatcgccacgaccctcagcttcgcggggagccgcccccaggcgacggtcaacggctggtccggccccgtcccggccgccccgaccaagatcgacagccgcggcgtgacgcgcggcgcctatcgcgggtacggcgagatctataccgtcaacatccccgccggcacgctcgtcgctggcatcaacaccatcacaatcagttccgtctctggcagcgatggagatgccttcctgagccccaacttttcttggacagccaaggtcttggatcttctcgactgtgccccccaagtgcttgccggcttgaagctt

SEQ ID NO: 91 - DNA, 2523 bp, Chrysosporium lucknowense
  CDS (854)..(932)
  CDS (1006)..(1426)
  CDS (1493)..(1551)
  CDS (1616)..(1857)
  CDS (1935)..(2495)
acgtcccgtcgcatgatcgcatggctatccgaccgccttggcaatgcttatttaccgccaagaggcaccagaccaggtcacgattcgtccatccctgtggagcctggcttcacctgagccctggggtcacgaaacaagctccagcgcccaggaaagccaaggaagatcttcttcgcctaccgcgatagcgtactatgtagaggaatggaggggcatcacgtcatccgccacttcctgggtggacaataaggtaccttttcgactctttcggcgtttatcatgcacaaaaagggacaatgggggcggcagttcttcagaagagcgagcgggtgggaacggggaatccggaaattcgaatcgggaagaatgtggaaggaagggcttccgaggtcccgacagggatcagccagaccatggaccaactgcgacgcgtttccgtgcacatcctccgtgaaatgcccatttcccagtatgcgagctaggccctgaaatgttaggatgacccactcgaaacgatattctgttagatgcttccctttagcgcccgcgtgtggctatcgttgcttgcgtacccccctccccccgagaggaagtcgcgccaggggcacacagcccacactaacatactcatcgactggggaacacagcacccgtcgttccaagttttcctttctttctcctgggccaagccgcgccgcaagacccctcttcctggcactgcaagtttgtgagacggggtcgtcgtctgcgcagccaaagacctgcccttgctctcgttgtttcgcgccttgcgcctccgaccttagtcactcgcttgattatttcaaaatcgaaaaaaaaaaagtcgaagaagatggtctggacacggttcgcggccgccgcccttgctggggccggcgtcgcaagcgccgcctacagcattgcgacaaccggtgagttacctagtagtttactgtcgacccttcatcaatctcctgcccaagactgacaagagcgacgcaatagacggcatcaagaagaccgccgcggacgtcgcttgggatcttttgcagtactatcacggaaacgagtcagggcagacgcccggaatcctgcctggtcctcccccgaatggtgattactactggtgggaggccggtgccatgtgggggaccttcatcgattattggaagttgacgggcgactcgacgtacaacgacctggtcacccaagcgatgctttttcaggttggcccagatcgggactataggccgcccaactacacggcctcgcttggcaacgacgaccaggcattctggggcatgtcggccatgactgccgccgagaacaactttcccaatccaccggccgaccagccgcagtggctcgctctcgcccaagccgtcttcaacacccaggcctcccccgaagagcacgacgatacttggtacgggtcccctttccgttttgtccagctccaggccttctgaagacccggactaatcgagaacagcaacggcgggttgcggtggcagatctacctctccaacaacggatacgattacaagaacagtaagagacaacccccctcacatggacgctgccgggttgttcagtccgcgctgacagcaaccaggcattgccaacggctgtttctttaacttgggcgcacgactagcgcgttacaccggcaacaaaacatacgccgagtgggccgagaaaacatgggactgggtgaggggcgtcggttacatggacgaccagtacaacatctacgacggagggcatgtgcagcacaattgcaccgacatcaaccgtgcccagttctcgtacaacaacgccgtctacctcctcggcgcggcgttcatgtacaattatgtaagttcctgtttgttcctccccgcacaaccgcggccggctctcgcatgcggctgctaacggatgccggcccacagaccaacggtagcgacaagtggagagaggccatcgagggcctggccgacgccaccatcaagacgttcttccccgacggggtggcgtacgagatcgcatgcgagcagggcatgacatgcacggccgacatgctcagcttcaaggggtacctgcaccgctggttggctacggccacgcaggttgcgcccatcctgtccgagaagatcctcccggtcctcaagacgtcgaccgaggccgccgtgagcacctgcacgggcgaggccaacggtcgcacgtgtggcttccagtggagcaagcgccagtacgacggcagccacggcgccggccagcagatgaacgtcctcgctgccgtgtcgtcgctgctgatcgaccagagcccgccgccctatacgaacatgtccggcggcaccagcaagggcgatcccctggccgggacgaactcgcgcagcacgctgaacgagccgcgccagatcacgggcggagacagagccggtgccggcattcttaccattctcctcatagctgcgggagtcggcacgtttgggtggatgagcaccggggtttgattttggattgggtatgtatgtaaaa

SEQ ID NO: 92 - protein, 454 aa, Chrysosporium lucknowense
MVWTRFAAAALAGAGVASAAYSIATTDGIKKTAADVAWDLLQYYHGNESGQTPGILPGPPPNGDYYWWEAGAMWGTFIDYWKLTGDSTYNDLVTQAMLFQVGPDRDYRPPNYTASLGNDDQAFWGMSAMTAAENNFPNPPADQPQWLALAQAVFNTQASPEEHDDTCNGGLRWQIYLSNNGYDYKNSIANGCFFNLGARLARYTGNKTYAEWAEKTWDWVRGVGYMDDQYNIYDGGHVQHNCTDINRAQFSYNNAVYLLGAAFMYNYTNGSDKWREAIEGLADATIKTFFPDGVAYEIACEQGMTCTADMLSFKGYLHRWLATATQVAPILSEKILPVLKTSTEAAVSTCTGEANGRTCGFQWSKRQYDGSHGAGQQMNVLAAVSSLLIDQSPPPYTNMSGGTSKGDPLAGTNSRSTLNEPRQITGGDRAGAGILTILLIAAGVGTFGWMSTGV

SEQ ID NO: 93 - DNA, 1362 bp, Chrysosporium lucknowense
atggtctggacacggttcgcggccgccgcccttgctggggccggcgtcgcaagcgccgcctacagcattgcgacaaccgacggcatcaagaagaccgccgcggacgtcgcttgggatcttttgcagtactatcacggaaacgagtcagggcagacgcccggaatcctgcctggtcctcccccgaatggtgattactactggtgggaggccggtgccatgtgggggaccttcatcgattattggaagttgacgggcgactcgacgtacaacgacctggtcacccaagcgatgctttttcaggttggcccagatcgggactataggccgcccaactacacggcctcgcttggcaacgacgaccaggcattctggggcatgtcggccatgactgccgccgagaacaactttcccaatccaccggccgaccagccgcagtggctcgctctcgcccaagccgtcttcaacacccaggcctcccccgaagagcacgacgatacttgcaacggcgggttgcggtggcagatctacctctccaacaacggatacgattacaagaacagcattgccaacggctgtttctttaacttgggcgcacgactagcgcgttacaccggcaacaaaacatacgccgagtgggccgagaaaacatgggactgggtgaggggcgtcggttacatggacgaccagtacaacatctacgacggagggcatgtgcagcacaattgcaccgacatcaaccgtgcccagttctcgtacaacaacgccgtctacctcctcggcgcggcgttcatgtacaattataccaacggtagcgacaagtggagagaggccatcgagggcctggccgacgccaccatcaagacgttcttccccgacggggtggcgtacgagatcgcatgcgagcagggcatgacatgcacggccgacatgctcagcttcaaggggtacctgcaccgctggttggctacggccacgcaggttgcgcccatcctgtccgagaagatcctcccggtcctcaagacgtcgaccgaggccgccgtgagcacctgcacgggcgaggccaacggtcgcacgtgtggcttccagtggagcaagcgccagtacgacggcagccacggcgccggccagcagatgaacgtcctcgctgccgtgtcgtcgctgctgatcgaccagagcccgccgccctatacgaacatgtccggcggcaccagcaagggcgatcccctggccgggacgaactcgcgcagcacgctgaacgagccgcgccagatcacgggcggagacagagccggtgccggcattcttaccattctcctcatagctgcgggagtcggcacgtttgggtggatgagcaccggggtt

SEQ ID NO: 94 - DNA, 1614 bp, Chrysosporium lucknowense
  CDS (432)..(532)
  CDS (755)..(1329)
  CDS (1426)..(1475)
  CDS (1547)..(1582)
gaacaaaaacaaactgctctgccctttccaggtttccccaaccccccattggttctttggtggaccgggacaaacggcaatcagcggatatagctgtcaatatcaaacaagccggggccaacatcagcgcttccatatgtagattatggatgcggggattttaccgagacacatagtatggcccgcaactgccgtgcgcgcatggaagatggatgaaggttcaactggcaccgctgctcttagatttttcctcctctcatcgtctttggctattagatgtcaaaactcttcggtaccgctcgtcgattaccggccaagacttgcgcttattatctagcggcgtcttctaccccaactatggtctctattatcgcctagacacgtacctgcagaagaagcgcgcgcccagaaagccatcttgaatacgaaccatggccctccagctcttggcgagcttggccctcctctcagtgccggcccttgcccacggtggcttggccaactacaccgtcggtgatacttggtacagagggtgcgtacaatgtttgagaggaaccgtccgtcgtccgtcatgatagcggggtacactaatatggaggcatcccaccgacacaagccaagcctagcctcgtctatgcttcggcccctccggccctcccaacccacgaaatatgacactccctcgaaaaaaaaaaaaaaaaaaaaaaaaaaaaacagttagattgcggcactgacatgcctgctcccctcctagctacgacccaaacctgccgccggagacgcagctcaaccagacctggatgatccagcggcaatgggccaccatcgaccccgtcttcaccgtgtcggagccgtacctggcctgcaacaacccgggcgcgccgccgccctcgtacatccccatccgcgccggtgacaagatcacggccgtgtactggtactggctgcacgccatcgggcccatgagcgtctggctcgcgcggtgcggcgacacgcccgcggccgactgccgcgacgtcgacgtcaaccgggtcggctggttcaagatctgggagggcggcctgctggagggtcccaacctggccgaggggctctggtaccaaaaggacttccagcgctgggacggctccccgtccctctggcccgtcacgatccccaaggggctcaagagcgggacctacatcatccggcacgagatcctgtcgcttcacgtcgccctcaagccccagttttacccggagtgtgcgcatctgaatattactgggggcggagacttgctgccacccgaagagactctggtgcggtttccgggggtttacaaagaggacggtgagtggtgcacggaacctccatcgtttgcttcttcgagcagggaaaataaggaaataaaagtggtagggggatatggtgctgatggggaaacagatccctctatcttcatcgatgtctactcggaggagaacgcgaaccggacagtaagtgttctcaacgggagtcaggcggttgtttccaaaagaaagaaagaaagcgtgctaatgaaggacaggattatacggttccgggagggccaatctgggaagggtgagttctagcccgcgcagttgtgcactttta

SEQ ID NO: 95 - protein, 254 aa, Chrysosporium lucknowense
MALQLLASLALLSVPALAHGGLANYTVGDTWYRGYDPNLPPETQLNQTWMIQRQWATIDPVFTVSEPYLACNNPGAPPPSYIPIRAGDKITAVYWYWLHAIGPMSVWLARCGDTPAADCRDVDVNRVGWFKIWEGGLLEGPNLAEGLWYQKDFQRWDGSPSLWPVTIPKGLKSGTYIIRHEILSLHVALKPQFYPECAHLNITGGGDLLPPEETLVRFPGVYKEDDPSIFIDVYSEENANRTDYTVPGGPIWEG

SEQ ID NO: 96 - DNA, 762 bp, Chrysosporium lucknowense
atggccctccagctcttggcgagcttggccctcctctcagtgccggcccttgcccacggtggcttggccaactacaccgtcggtgatacttggtacagaggctacgacccaaacctgccgccggagacgcagctcaaccagacctggatgatccagcggcaatgggccaccatcgaccccgtcttcaccgtgtcggagccgtacctggcctgcaacaacccgggcgcgccgccgccctcgtacatccccatccgcgccggtgacaagatcacggccgtgtactggtactggctgcacgccatcgggcccatgagcgtctggctcgcgcggtgcggcgacacgcccgcggccgactgccgcgacgtcgacgtcaaccgggtcggctggttcaagatctgggagggcggcctgctggagggtcccaacctggccgaggggctctggtaccaaaaggacttccagcgctgggacggctccccgtccctctggcccgtcacgatccccaaggggctcaagagcgggacctacatcatccggcacgagatcctgtcgcttcacgtcgccctcaagccccagttttacccggagtgtgcgcatctgaatattactgggggcggagacttgctgccacccgaagagactctggtgcggtttccgggggtttacaaagaggacgatccctctatcttcatcgatgtctactcggaggagaacgcgaaccggacagattatacggttccgggagggccaatctgggaaggg

SEQ ID NO: 97 - DNA, 1509 bp, Chrysosporium lucknowense
  CDS (89)..(145)
  CDS (340)..(372)
  CDS (490)..(722)
  CDS (844)..(892)
  CDS (1020)..(1272)
  CDS (1365)..(1405)
gtagcaggacattaacagcagcaaataattgttgtaaattgctccaagtccttcttcccccttcctctgtcggacagacaaaatcacgatgaagacgctcgccgccctcgtggtctcggccgccctcgtggccgcgcacggctatgttgaccacgccacgatcggtggcaaggattatcaggtaaaaaagaaaaaaaaaaacccaaacggcaactcccgtgggatgcatggtcggcaagtggctaacaagacgacccttatagttctaccaggtacgctcggtaccagtcatttggctccctctgccggcagttcctgacacgcatctcccacatttagccgtaccaggacccttacatgggcgacaacaaggtaacaatgaaccataatactaaaccagacaccccccctttcctccccgggggcccaaccttctctgatgcagcgatcgaacacccgctaaacaagggggtgtgaggggggtctcagcccgatagggtttcccgctccatcccgggcaacggccccgtggaggacgtcaactccatcgacctccagtgccacgccggtgccgaaccggccaagctccacgcccccgccgccgccggctcgaccgtgacgctctactggaccctctggcccgactcccacgtcggccccgtcatcacctacatggctcgctgccccgacaccggctgccaggactggtccccgggaactaagtaaggcatttccgaaaataattcaaccccgtttccttggggtgggaataaaatgaaggaggggaagggggggggagtcattggtgctaggtgctaactctcttgttccccctgataataggcccgtttggttcaagatcaaggaaggcggccgtgagggcacctccaatgtctgtggctgctgtgagtcacccgattctgtttctgcatttcaatccctcgagaggagaaggaaaaaaaaaaacgaaacaaacaggaacaaggggaaacaatgacactgacctgtctcctctgaagaccccgctcatgacggccccctccgcctacacctacacgatcccgtcctgcctcaagagcggctactacctcgtccgccacgagatcatcgccctgcactcggcctggcagtaccccggcgcccagttctacccgggctgccaccagctccaggtcaccggcggcggctccaccgtgccctctaccaacctggtctccttccccggcgcctacaaggggagcgaccccggcatcacctacgacgcttacaagggtgagcgcttctttttactttctttcttttttttttctttcttaattctctgttttggaacagggcgactgacgactgacgcggagttgcagcgcaaccttacaccatccctggcccggccgtgtttacctgctgagcagcaacccgtgtcctcggcggagaaagtgggagttgttgatttgggaggagtgccagggccagggccagggccagaggctatgtataggggggtgtggg

SEQ ID NO: 98 - protein, 222 aa, Chrysosporium lucknowense
MKTLAALVVSAALVAAHGYPYQDPYMGDNKPDRVSRSIPGNGPVEDVNSIDLQCHAGAEPAKLHAPAAAGSTVTLYWTLWPDSHVGPVITYMARCPDTGCQDWSPGTKPVWFKIKEGGREGTSNTPLMTAPSAYTYTIPSCLKSGYYLVRHEIIALHSAWQYPGAQFYPGCHQLQVTGGGSTVPSTNLVSFPGAYKGSDPGITYDAYKAQPYTIPGPAVFTC

SEQ ID NO: 99 - DNA, 666 bp, Chrysosporium lucknowense
atgaagacgctcgccgccctcgtggtctcggccgccctcgtggccgcgcacggctatccgtaccaggacccttacatgggcgacaacaagcccgatagggtttcccgctccatcccgggcaacggccccgtggaggacgtcaactccatcgacctccagtgccacgccggtgccgaaccggccaagctccacgcccccgccgccgccggctcgaccgtgacgctctactggaccctctggcccgactcccacgtcggccccgtcatcacctacatggctcgctgccccgacaccggctgccaggactggtccccgggaactaagcccgtttggttcaagatcaaggaaggcggccgtgagggcacctccaataccccgctcatgacggccccctccgcctacacctacacgatcccgtcctgcctcaagagcggctactacctcgtccgccacgagatcatcgccctgcactcggcctggcagtaccccggcgcccagttctacccgggctgccaccagctccaggtcaccggcggcggctccaccgtgccctctaccaacctggtctccttccccggcgcctacaaggggagcgaccccggcatcacctacgacgcttacaaggcgcaaccttacaccatccctggcccggccgtgtttacctgc

SEQ ID NO: 100 - DNA, 2238 bp, Chrysosporium lucknowense
  CDS (546)..(744)
  CDS (805)..(1940)
ctttcaaaccgcagcggcgcagctcaacatccgaatatcactgttcggcggcagccgctgacgctcgtggtcttttgtgctcagctcattttgggttagttggggcgtcctggttgccggttgttctgttgtctgttttctcaagtcgcgaggcttcctttctttcttccttacccccggtctgagttggtttcccttccatggcaccggccattttagggcctccttcttcggactcgtcgatcttctcgtactcaagtcgagctcggctctccgtttcgctcgttgggactcacttggcctcaacagactccaccggtgtccctcaaagtttcatctcacttcaatgctggccactcctttgactatcacggtgggaatccttccaaaaccccactgattcgtttctctttctctcaggcagtaagaaataagttcttccctggtggacgacgctatattcgcttcaacttcagaaatccctttccaaactgtgtcttctccccccatttctctctttctgcaagaactggcctttgttgttgatgatgcacccctcccttcttttcacgcttgggctggcgagcgtgcttgtccccctctcgtctgcacacactaccttcacgaccctcttcgtcaacgatgtcaaccaaggtgatggtacctgcattcgcatggcgaagaagggcaatgtcgccacccatcctctcgcaggcggtctcgactccgaagacatggcctgtggtacgttgacaagtctttgaccccgttgggagtgtttcatgtatctaaccacaatattaggtcgggatggtcaagaacccgtggcatttacgtgtccggccccagctggtgccaagttgactctcgagtttcgcatgtgggccgatgcttcgcagtccggatcgatcgatccatcccaccttggcgtcatggccatctacctcaagaaggtttccgacatgaaatctgacgcggccgctggcccgggctggttcaagatttgggaccaaggctacgacttggcggccaagaagtgggccaccgagaagctcatcgacaacaacggcctcctgagcgtcaaccttccaaccggcttaccaaccggctactacctcgcccgccaggagatcatcacgctccaaaacgttaccaatgacaggccagagccccagttctacgtcggctgcgcacagctctacgtcgagggcacctcggactcacccatcccctcggacaagacggtctccattcccggccacatcagcgacccggccgacccgggcctgaccttcaacgtctacacgggcgacgcatccacctacaagccgcccggccccgaggtttacttccccaccaccaccaccaccacctcctcctcctcctccggaagcagcgacaacaagggagccaggcgccagcaaacccccgacgacaagcaggccgacggcctcgttccagccgactgcctcgtcaagaacgcgaactggtgcgccgctgccctgccgccgtacaccgacgaggccggctgctgggccgccgccgaggactgcaacaagcagctggacgcgtgctacaccagcgcacccccctcgggcagcaaggggtgcaaggtctgggaggagcaggtgtgcaccgtcgtctcgcagaagtgcgaggccggggatttcaaggggcccccgcagctcgggaaggagctcggcgaggggatcgatgagcctattccggggggaaagctgcccccggcggtcaacgcgggagagaacgggaatcatggcggaggtggtggtgatgatggtgatgatgataatgatgaggccggggctggggcagcgtcgactccgacttttgctgctcctggtgcggccaagactccccaaccaaactccgagagggcccggcgccgtgaggcgcattggcggcgactggaatctgctgagtagtggtgcttgagggggattccggacgggtgtcttagctgatgatggacggcctggccgccgatccactccattctctaacgagacacgccctgacgttactttacgctctgcttttcaatccgtcaacttcgcttgctcttgttctacggcagtatgcttaatttagaaagcggctggatcgtcgacttgatagcgtctattattaattattaaagcgcgtattatcaaagctctgctacgggagaaagaaaaaaaaagcgatcttcagctcccgagctcacatcttgcgaataaa

SEQ ID NO: 101 - protein, 445 aa, Chrysosporium lucknowense
MMHPSLLFTLGLASVLVPLSSAHTTFTTLFVNDVNQGDGTCIRMAKKGNVATHPLAGGLDSEDMACGRDGQEPVAFTCPAPAGAKLTLEFRMWADASQSGSIDPSHLGVMAIYLKKVSDMKSDAAAGPGWFKIWDQGYDLAAKKWATEKLIDNNGLLSVNLPTGLPTGYYLARQEIITLQNVTNDRPEPQFYVGCAQLYVEGTSDSPIPSDKTVSIPGHISDPADPGLTFNVYTGDASTYKPPGPEVYFPTTTTTTSSSSSGSSDNKGARRQQTPDDKQADGLVPADCLVKNANWCAAALPPYTDEAGCWAAAEDCNKQLDACYTSAPPSGSKGCKVWEEQVCTVVSQKCEAGDFKGPPQLGKELGEGIDEPIPGGKLPPAVNAGENGNHGGGGGDDGDDDNDEAGAGAASTPTFAAPGAAKTPQPNSERARRREAHWRRLESAE

SEQ ID NO: 102 - DNA, 1335 bp, Chrysosporium lucknowense
atgatgcacccctcccttcttttcacgcttgggctggcgagcgtgcttgtccccctctcgtctgcacacactaccttcacgaccctcttcgtcaacgatgtcaaccaaggtgatggtacctgcattcgcatggcgaagaagggcaatgtcgccacccatcctctcgcaggcggtctcgactccgaagacatggcctgtggtcgggatggtcaagaacccgtggcatttacgtgtccggccccagctggtgccaagttgactctcgagtttcgcatgtgggccgatgcttcgcagtccggatcgatcgatccatcccaccttggcgtcatggccatctacctcaagaaggtttccgacatgaaatctgacgcggccgctggcccgggctggttcaagatttgggaccaaggctacgacttggcggccaagaagtgggccaccgagaagctcatcgacaacaacggcctcctgagcgtcaaccttccaaccggcttaccaaccggctactacctcgcccgccaggagatcatcacgctccaaaacgttaccaatgacaggccagagccccagttctacgtcggctgcgcacagctctacgtcgagggcacctcggactcacccatcccctcggacaagacggtctccattcccggccacatcagcgacccggccgacccgggcctgaccttcaacgtctacacgggcgacgcatccacctacaagccgcccggccccgaggtttacttccccaccaccaccaccaccacctcctcctcctcctccggaagcagcgacaacaagggagccaggcgccagcaaacccccgacgacaagcaggccgacggcctcgttccagccgactgcctcgtcaagaacgcgaactggtgcgccgctgccctgccgccgtacaccgacgaggccggctgctgggccgccgccgaggactgcaacaagcagctggacgcgtgctacaccagcgcacccccctcgggcagcaaggggtgcaaggtctgggaggagcaggtgtgcaccgtcgtctcgcagaagtgcgaggccggggatttcaaggggcccccgcagctcgggaaggagctcggcgaggggatcgatgagcctattccggggggaaagctgcccccggcggtcaacgcgggagagaacgggaatcatggcggaggtggtggtgatgatggtgatgatgataatgatgaggccggggctggggcagcgtcgactccgacttttgctgctcctggtgcggccaagactccccaaccaaactccgagagggcccggcgccgtgaggcgcattggcggcgactggaatctgctgag

SEQ ID NO: 103 - DNA, 1033 bp, Chrysosporium lucknowense
  CDS (165)..(899)
aaaactctctcgtcagtaatgtccgacaactccacgcacttcaccataacctccacaacagttcccccccggcggtcacttgccaatccttctcgagacccacccgatccccaacaccccagcacccccgcacctcagacagacacatactagtacacgcaccaatgctcctcctcaccctagccacactcgtcaccctcctggcgcgccacgtctcggctcacgcccggctgttccgcgtctctgtcgacgggaaagaccagggcgacgggctgaacaagtacatccgctcgccggcgaccaacgaccccgtgcgcgacctctcgagcgccgccatcgtgtgcaacacccaggggtccaaggccgccccggacttcgtcagggccgcggccggcgacaagctgaccttcctctgggcgcacgacaacccggacgacccggtcgactacgtcctcgacccgtcccacaagggcgccatcctgacctacgtcgccgcctacccctccggggacccgaccggccccatctggagcaagcttgccgaggaaggattcaccggcgggcagtgggcgaccatcaagatgatcgacaacggcggcaaggtcgacgtgacgctgcccgaggcccttgcgccgggaaagtacctgatccgccaggagctgctggccctgcaccgggccgactttgcctgcgacgacccggcccaccccaaccgcggcgccgagtcgtaccccaactgcgtccaggtggaggtgtcgggcagcggcgacaagaagccggaccagaactttgacttcaacaagggctatacctgcgataacaaaggactccactttaagatctacatcggtcaggacagccagtatgtggccccggggccgcggccttggaatgggagctgagaggttccggcccgggttttgggcaccttgatcggaggcgggacgcgagtaatctcccttgatttgctgatatagatctgtatttcgttcaccatcccttctcgttcttagatgttttgttcgataataat

SEQ ID NO: 104 - protein, 245 aa, Chrysosporium lucknowense
MLLLTLATLVTLLARHVSAHARLFRVSVDGKDQGDGLNKYIRSPATNDPVRDLSSAAIVCNTQGSKAAPDFVRAAAGDKLTFLWAHDNPDDPVDYVLDPSHKGAILTYVAAYPSGDPTGPIWSKLAEEGFTGGQWATIKMIDNGGKVDVTLPEALAPGKYLIRQELLALHRADFACDDPAHPNRGAESYPNCVQVEVSGSGDKKPDQNFDFNKGYTCDNKGLHFKIYIGQDSQYVAPGPRPWNGS

SEQ ID NO: 105 - DNA, 735 bp, Chrysosporium lucknowense
atgctcctcctcaccctagccacactcgtcaccctcctggcgcgccacgtctcggctcacgcccggctgttccgcgtctctgtcgacgggaaagaccagggcgacgggctgaacaagtacatccgctcgccggcgaccaacgaccccgtgcgcgacctctcgagcgccgccatcgtgtgcaacacccaggggtccaaggccgccccggacttcgtcagggccgcggccggcgacaagctgaccttcctctgggcgcacgacaacccggacgacccggtcgactacgtcctcgacccgtcccacaagggcgccatcctgacctacgtcgccgcctacccctccggggacccgaccggccccatctggagcaagcttgccgaggaaggattcaccggcgggcagtgggcgaccatcaagatgatcgacaacggcggcaaggtcgacgtgacgctgcccgaggcccttgcgccgggaaagtacctgatccgccaggagctgctggccctgcaccgggccgactttgcctgcgacgacccggcccaccccaaccgcggcgccgagtcgtaccccaactgcgtccaggtggaggtgtcgggcagcggcgacaagaagccggaccagaactttgacttcaacaagggctatacctgcgataacaaaggactccactttaagatctacatcggtcaggacagccagtatgtggccccggggccgcggccttggaatgggagc

SEQ ID NO: 106 - DNA, 1390 bp, Chrysosporium lucknowense
  CDS (136)..(187)
  CDS (387)..(722)
  CDS (878)..(1161)
agagatgtggttcagtgaaggctcgcttcgtggagctgctccagtgtcacgaactacttcttcgtatcttgccagaacctattgaataacagcgcctcttgagaccgtcgaggccattgacatcaggtcatcgatatgaggcttctcgcaagcttgttgctcgcagctacggctgttcaagctcactgtacgctcaccactcccaggcctgacatctgtttacacatccacctgccatgacataattatgttagctaccaaatattcatgtcgcatttttcttctcccacacctccgcgccaaccgcaggaacatgagagattgacggctaacactattttgctctcctctcatctctcttttcttaaacaccttcccgagactagttgttaacggacagcccgaagagagtgactggtcagccacgcgcatgaccaagaatgcgcagagcaagcagggcgttgagaacccaacaagcggcgacatccgctgctacacctcgcagacggcggccaacgtcgtgaccgtgccggccggctcgaccattcactacatctcgacccagcagatcaaccaccccggcccgactcagtactacctggccaaggtaccccccggctcgtcggccaagacctttgacgggtccggcgccgtctggttcaagatctcgaccacgatgcctaccgtggacagcaacaagcagatgttctggccagggcagagtatggaacccctctctttctcttctctggggctgagcagatttccgcgactgcggtgatgagtcggcagtccgagaacgtaataacccgtcatgtccaaatattagtgccaactaatattttttttcttattttcttgtacgcgcttgttgcagacacttatgagacctcaaacaccaccattcccgccaacaccccggacggcgagtacctccttcgcgtcaagcagatcgccctccacatggcgtctcagcccaacaaggtccagttctacctcgcctgcacccagatcaagatcaccggtggtcgcaacggcacccccagcccgctggtcgcgctgcccggagcctacaagagcaccgaccccggcatcctggtcgacatctactccatgaagcccgaatcgtaccagcctcccgggccgcccgtctggcgcggctaatcagtcgatgagtaggaatgcatggtatccctgttatcctctttctcccggtgccttgagggccagttgcaagccggtctggttcaccaaatgtttctctgagctgctttgtcccttcgttccttgacttcggtctgtcaggcgtactcccaagaacgacaaggtaggaggggcaaggggagagggaggatggatgtatagtcaggacggtctgaatgccaatcaa

SEQ ID NO: 107 - protein, 224 aa, Chrysosporium lucknowense
MRLLASLLLAATAVQAHFVNGQPEESDWSATRMTKNAQSKQGVENPTSGDIRCYTSQTAANVVTVPAGSTIHYISTQQINHPGPTQYYLAKVPPGSSAKTFDGSGAVWFKISTTMPTVDSNKQMFWPGQNTYETSNTTIPANTPDGEYLLRVKQIALHMASQPNKVQFYLACTQIKITGGRNGTPSPLVALPGAYKSTDPGILVDIYSMKPESYQPPGPPVWRG

SEQ ID NO: 108 - DNA, 672 bp, Chrysosporium lucknowense
atgaggcttctcgcaagcttgttgctcgcagctacggctgttcaagctcactttgttaacggacagcccgaagagagtgactggtcagccacgcgcatgaccaagaatgcgcagagcaagcagggcgttgagaacccaacaagcggcgacatccgctgctacacctcgcagacggcggccaacgtcgtgaccgtgccggccggctcgaccattcactacatctcgacccagcagatcaaccaccccggcccgactcagtactacctggccaaggtaccccccggctcgtcggccaagacctttgacgggtccggcgccgtctggttcaagatctcgaccacgatgcctaccgtggacagcaacaagcagatgttctggccagggcagaacacttatgagacctcaaacaccaccattcccgccaacaccccggacggcgagtacctccttcgcgtcaagcagatcgccctccacatggcgtctcagcccaacaaggtccagttctacctcgcctgcacccagatcaagatcaccggtggtcgcaacggcacccccagcccgctggtcgcgctgcccggagcctacaagagcaccgaccccggcatcctggtcgacatctactccatgaagcccgaatcgtaccagcctcccgggccgcccgtctggcgcggc

SEQ ID NO: 109 - DNA, 1728 bp, Chrysosporium lucknowense
  CDS (81)..(1691)
ttcgtgatcctagccccgagccagcaaagctcgccaggtccccgtccataggtcccgtccataggtcccgtccagccaccatgccgcaggttcgaaaccccatcctccccggcttcaaccccgacccttccatcctccgggttggggatgactactacatcgccacttcaacctttgagtggtacccgggtgttcagatccaccactccatggacctcgcaaactgggaacttgtcacccgtcccctaaaccgcaagagccaactggatatgcgaggagatccggacagctgcggcatctgggctccctgcctgacgcatgacggcgacaggttctggctggtatacacggacgtcaaacgcaaggacggctcgttcaaggacgcacacaactacatcgtcagtgcgcccgccatcgagggtccctggtcggaccccttctatgtcaactcgtccgggttcgacccctcgctcttccatgacgacgacggccggaagtggttcgtcaacatgatgtgggaccaccgcagccgcccgcgaacctttgccggcatcgcgctgcaagagttcgaccccaaggccgggaagctggttgggccgcgcaagaacatttaccaaggcaccgacctgggcctcgtcgagggcccgcacttgtacaagcgcaacgggtggtactatctcctgacagcagagggcgggactggctatgagcatgcctgcaccctcgcccggtctcggaacatctggggcccgtacgaagatcacccgcagaagtacatcttgacgtctaaggaccacccgcacgcagccctgcagcgagccggccacggcgacatcgtcgacacccccgacgggcgtacctacgtcgttcacctgaccggccggcccatcacgcagttccgccgctgtgtcttggggcgcgagacggccatccaggaggcctactggggcgacgacgactggctctacgtcaagaacggccctgtgcccagcctgttcgtggacctcccggccgcccgcaacgacgacgactactgggccgagaagaggtacacgttcgaggcgggcctgcacaaggacttccagtggctgcgcacgcccgagacggaccgcatcttcaggacggacaacgggaagttgacgctcatcggccgcgagtccatcggctcctggttcgagcaggccctggtcgcccggcgccagacgcacttctcgtacgacgccgagaccgtcatcgacttcaagcctgccgacgagcgccagttcgccggcctgacggcctattactgccgctacaacttcttctacctgaccgtcacggcccactcggacggccggcgggagctgctcatcatggcctccgaggcctcctggcccctcggcgccctccggtccccttatccgggacccgtccagatccccaacgagggcaaggtccggctcgcgctcaagatcaggggcaaggagctgcagttctactacgctctcgagggcgaagagctaaaacagattgggcccgtattcgacgctagcatcgtttctgacgagtgcggcggccaccagaagcacggcagcttcacgggcgccttcgtcggcgtggctgcttccgacatcaacggtactgctgccgaggcgacctttgactactttgtgtacaagcccgtgcaccatgagagtgaccggtacgagatttaagtgattgatgaggttctaatagcgttgtaataca

SEQ ID NO: 110 - protein, 537 aa, Chrysosporium lucknowense
MPQVRNPILPGFNPDPSILRVGDDYYIATSTFEWYPGVQIHHSMDLANWELVTRPLNRKSQLDMRGDPDSCGIWAPCLTHDGDRFWLVYTDVKRKDGSFKDAHNYIVSAPAIEGPWSDPFYVNSSGFDPSLFHDDDGRKWFVNMMWDHRSRPRTFAGIALQEFDPKAGKLVGPRKNIYQGTDLGLVEGPHLYKRNGWYYLLTAEGGTGYEHACTLARSRNIWGPYEDHPQKYILTSKDHPHAALQRAGHGDIVDTPDGRTYVVHLTGRPITQFRRCVLGRETAIQEAYWGDDDWLYVKNGPVPSLFVDLPAARNDDDYWAEKRYTFEAGLHKDFQWLRTPETDRIFRTDNGKLTLIGRESIGSWFEQALVARRQTHFSYDAETVIDFKPADERQFAGLTAYYCRYNFFYLTVTAHSDGRRELLIMASEASWPLGALRSPYPGPVQIPNEGKVRLALKIRGKELQFYYALEGEELKQIGPVFDASIVSDECGGHQKHGSFTGAFVGVAASDINGTAAEATFDYFVYKPVHHESDRYEI

SEQ ID NO: 111 - DNA, 1611 bp, Chrysosporium lucknowense
atgccgcaggttcgaaaccccatcctccccggcttcaaccccgacccttccatcctccgggttggggatgactactacatcgccacttcaacctttgagtggtacccgggtgttcagatccaccactccatggacctcgcaaactgggaacttgtcacccgtcccctaaaccgcaagagccaactggatatgcgaggagatccggacagctgcggcatctgggctccctgcctgacgcatgacggcgacaggttctggctggtatacacggacgtcaaacgcaaggacggctcgttcaaggacgcacacaactacatcgtcagtgcgcccgccatcgagggtccctggtcggaccccttctatgtcaactcgtccgggttcgacccctcgctcttccatgacgacgacggccggaagtggttcgtcaacatgatgtgggaccaccgcagccgcccgcgaacctttgccggcatcgcgctgcaagagttcgaccccaaggccgggaagctggttgggccgcgcaagaacatttaccaaggcaccgacctgggcctcgtcgagggcccgcacttgtacaagcgcaacgggtggtactatctcctgacagcagagggcgggactggctatgagcatgcctgcaccctcgcccggtctcggaacatctggggcccgtacgaagatcacccgcagaagtacatcttgacgtctaaggaccacccgcacgcagccctgcagcgagccggccacggcgacatcgtcgacacccccgacgggcgtacctacgtcgttcacctgaccggccggcccatcacgcagttccgccgctgtgtcttggggcgcgagacggccatccaggaggcctactggggcgacgacgactggctctacgtcaagaacggccctgtgcccagcctgttcgtggacctcccggccgcccgcaacgacgacgactactgggccgagaagaggtacacgttcgaggcgggcctgcacaaggacttccagtggctgcgcacgcccgagacggaccgcatcttcaggacggacaacgggaagttgacgctcatcggccgcgagtccatcggctcctggttcgagcaggccctggtcgcccggcgccagacgcacttctcgtacgacgccgagaccgtcatcgacttcaagcctgccgacgagcgccagttcgccggcctgacggcctattactgccgctacaacttcttctacctgaccgtcacggcccactcggacggccggcgggagctgctcatcatggcctccgaggcctcctggcccctcggcgccctccggtccccttatccgggacccgtccagatccccaacgagggcaaggtccggctcgcgctcaagatcaggggcaaggagctgcagttctactacgctctcgagggcgaagagctaaaacagattgggcccgtattcgacgctagcatcgtttctgacgagtgcggcggccaccagaagcacggcagcttcacgggcgccttcgtcggcgtggctgcttccgacatcaacggtactgctgccgaggcgacctttgactactttgtgtacaagcccgtgcaccatgagagtgaccggtacgagatt

SEQ ID NO: 112 - DNA, 1101 bp, Chrysosporium lucknowense
  CDS (44)..(1024)
aagagtaagtaagagcggtctctccagggacaagccatccgccatggcgcccctcatcaccaacatcttcacggccgacccgtcggcccacgtcttcgagggcaagctcttcatatacccgtcgcacgatcgcgagacggacatcaagttcaacgacgacggcgaccagtacgacatggtcgactaccacgtattcagcaccgagtcgctggacccggccgcccccgtgaccgaccacggcgtcgtgctccgggccgaagacgtcccctgggtgtccaagcagctctgggcccccgacgccgcctacaaggacggcaggtactacctctacttccccgcccgcgacaagcagggcgtcttccgcatcggcgtcgccgtcggcgaccgccccgagggccccttcacccccgacccggagcccatccgggacagctacagcatcgacccggccgtcttcgtcgacgacgacggccgggcctacatgtactttggcgggctctggggcggccagctgcagtgctaccagaagggcaacggcatcttcgaccccgagtggctggggcccagggagccctcgggcgagggcgtccgggcgctggggccgcgcgtcgcccggctggcggacgacatgcgccagttcgccagcgaggtgaaggagatttcgatcctggcgcccgagacgggcgagccgatcgcggccgacgaccacgaccgccgcttcttcgaggccgcctggatgcacaagtacgacggcaagtactacttcagctactccaccggcgacacccactacctcgtctacgccgtcggcgacagcccctacgggcccttcacctacgccggccgcatcctcgagcccgtcctcggctggaccacgcaccactccatcgtcgagttccacggccgctggtggctcttccaccacgactgcgagctcagcggcggagtcgaccacctgcgctccgtcaaggtcaaggagatcttctacgacaaggacggcaagattgtcactgaaaagcccgaataggcgttgtatatacatttacatatatatatgtaaacatctacgtatatataaagttaaactatgaaacaaataaa

SEQ ID NO: 113 - protein, 327 aa, Chrysosporium lucknowense
MAPLITNIFTADPSAHVFEGKLFIYPSHDRETDIKFNDDGDQYDMVDYHVFSTESLDPAAPVTDHGVVLRAEDVPWVSKQLWAPDAAYKDGRYYLYFPARDKQGVFRIGVAVGDRPEGPFTPDPEPIRDSYSIDPAVFVDDDGRAYMYFGGLWGGQLQCYQKGNGIFDPEWLGPREPSGEGVRALGPRVARLADDMRQFASEVKEISILAPETGEPIAADDHDRRFFEAAWMHKYDGKYYFSYSTGDTHYLVYAVGDSPYGPFTYAGRILEPVLGWTTHHSIVEFHGRWWLFHHDCELSGGVDHLRSVKVKEIFYDKDGKIVTEKPE

SEQ ID NO: 114 - DNA, 981 bp, Chrysosporium lucknowense
atggcgcccctcatcaccaacatcttcacggccgacccgtcggcccacgtcttcgagggcaagctcttcatatacccgtcgcacgatcgcgagacggacatcaagttcaacgacgacggcgaccagtacgacatggtcgactaccacgtattcagcaccgagtcgctggacccggccgcccccgtgaccgaccacggcgtcgtgctccgggccgaagacgtcccctgggtgtccaagcagctctgggcccccgacgccgcctacaaggacggcaggtactacctctacttccccgcccgcgacaagcagggcgtcttccgcatcggcgtcgccgtcggcgaccgccccgagggccccttcacccccgacccggagcccatccgggacagctacagcatcgacccggccgtcttcgtcgacgacgacggccgggcctacatgtactttggcgggctctggggcggccagctgcagtgctaccagaagggcaacggcatcttcgaccccgagtggctggggcccagggagccctcgggcgagggcgtccgggcgctggggccgcgcgtcgcccggctggcggacgacatgcgccagttcgccagcgaggtgaaggagatttcgatcctggcgcccgagacgggcgagccgatcgcggccgacgaccacgaccgccgcttcttcgaggccgcctggatgcacaagtacgacggcaagtactacttcagctactccaccggcgacacccactacctcgtctacgccgtcggcgacagcccctacgggcccttcacctacgccggccgcatcctcgagcccgtcctcggctggaccacgcaccactccatcgtcgagttccacggccgctggtggctcttccaccacgactgcgagctcagcggcggagtcgaccacctgcgctccgtcaaggtcaaggagatcttctacgacaaggacggcaagattgtcactgaaaagcccgaa

SEQ ID NO: 115 - DNA, 4189 bp, Chrysosporium lucknowense
  CDS (100)..(496)
  CDS (607)..(2493)
  CDS (2718)..(2756)
  CDS (2942)..(3104)
  CDS (3207)..(4038)
tctctcttcgttttctcatcatgggcaacgagagggtggactcgaccagtccgttccacacacccttcgccgactcgaccacggccgactgacgagatcatgaggttcctcccctcgacgttgcttcttgcggcggccgccctggctgccgacaaggggcgcccgagtctcaagaatgctgtgtacaagaaccccaaagcctcggtcgaggaccgtgtagccgaccttctctcccgaatgaccatcgaggagaaggcatcccagcttctccaaggtgacatccgcaactggatgaacgagacgaccaatgcgctcaaccagaccggtctggaatggagcaccagataccgggggagcgccttttatgtaggcgtccccgttcccaatgagtggctcacaaagcacatcaaggccgcccaggattacatccagaaggagacctacctgggtatcccggcctttgttcagaccgagggtcttcacggttttcttgctcgtgggttcccaccatctgttcacgcgccgcataattatttcatcccacccaccacaccaccgctccgctctcgagagcgccgatgattgctgactgtctcatgccctcagacaatgccaccatcttcagctcgcccataggactcggctgctcatggaacccgtccctggttgaggagatggcggctgccattgccaaagaggcgcgcgcccttggcgtcaaccagctctttgccccggtcgccgacctcgcgcgggaactccgccacggccgtgtcgaggagatgtacagcgaggacggcctcctcgccggcgagttcgcccgtgcctatgtcaagggcgcgcagtcggccggtgtcagtgccatggtcaagcactttgccgcctttggcgtgacggagcagggcttgaacacggggcccgtccacggcggcgaacgagagctgcgcacaacctatctgccgccctaccagcgcgccatcatcgacggaggggtctattccatcatgacggcctaccacagctacgacggcatccccgccgtgtccgacccccacctgctcaccgacatcctccgggacgaatggggttacggatacttcaccatgacagacgccggcgcctcggaccgcctctgcgccgacttcaagatgtgcgcctcggatcccatcgacaaggaagccatcgtcaagtacatcctcccggccggcggcgacgtggagatgggaggcgggtcgtactcgttcgagaagatccccgagctggtgtccagcggcaaggtcgaggaggagctcgtcgataccgccgtcgcccgcgtccttcgggccaagtttgagctcggcctcttcgagaaccccttcccgggcctcccgtccgaggaggcgaacaaggtgatccacgcgcccgagcacgtcgccctggcgaagaagctggacgaggagtccatcgtcctcctggagaaccacaacaacgtcctgccgctgagcaaggatgcgtccgtggccgtcatcggacccatggcgcacggattcatgaactacggcgactacgtcgtcgtcaactcttcgacccgcgggatcacgcccctcgacggcatcaaggcggccagccggggcaaggtcacgtacgcgaaaggctgcgagcgctggtccaactcgcaagacgggtttcccgaggccgtcgcggccgccgaggccgccgacgtcgccgtcgtcgtggtcggcacctggtctcgggaccagaacgagctctggcagggcctgaacgccaccacgggcgagcacgtcgacgtggacagcctcgacctggttggcgcccaggaggccctcgtccgcgccatcgtcgagacgggcaagccgaccgtggtcgtcttctcgtccggcaagcccgtcaccgcgccgtcgatctcggagcacgccgccgccctcgtccagcagttctacccctcggagcagggaggcgccgccctcgcctccatcctcttcggcgacgtgaacccgagcggcaggctcagcgtcagcttcccccgcagcgtcggcgacctgccggtctactacgactacttgaactcgggacgcggcgcctcgcctgatgcgggcgtcgcttacgagaacggcactctggtgtttgggcatcagtacgtcctgggtgacccgaggcctctgtacgagttcggttacgggctgagttactccaagttcgagtacggcgacgtcactgtcgacaagacgatcgtgacggcccaagacaccgtcaccgtcaccgtcaccgtcaagaacgtgtcgagtcgggaaggtcaggaggtcgtccaggtctacgtcaaggacctgatcgccagcgtcgtcgttcccaacattcggctgaggggattccagaagctgaagctgaggccgggagagagcaagcgagtgagcatcaaggtcaacgtacaggacctgggcgtctgggacgcgaggatgcgatacgttgttgagcccggcgactttctgttcctcgttggtgcgtcgagcaacgatttcaggggaaatgtcactgttactgtcaagtaggggggacagcaactgtttctaatgaacttatatatatgtatatacactgacgtacatataaaacctaaggtaccaagccttaatcgattagtgtagtgtcagctgatttcaaccacttatagttattcccttaccgactttacttaggaaggtactgtacctaattaggtttaggtaagacacctctgcggtacacggattggatcaggcaaagtatgtacatacatacttgagtttccccagctgagataataattaacgtaatctggccaagtttgggttcccagtaactacctaattagagcgcgttggcgtcgggtggaacaaattggaacaaacaagaccgtcattgtggggtcttggggttaattaggcaaaaccttccaccacaacaacagccttcttcggacacaactcgagaaattcacaccctgatcctcttacctgcagtttgtcggatttgccaaccatggacacctctaacaacaaagtcatcacgttttacgacatcatcctcgatccgacggcctaccctatctcaccaaacccgtggaagacgcggtaattaattatgccctgtgttcagtttaataattaatacccctcagctcttggtcttttaactttccaactaaccccctcccccctcttaccgccttcaagctacgcgctcaactttgccaaggtgccctatcgcacgacttgggtgccccttgctgccgtcgcagagacgcggaacgcgctgcaactccctgccaaccggaagcatgccgacggcagcgacttccccacgcttcccatcatccgcgacccgctcgccgcgactacgtccgggtccgaggtcgtcgtgggcgattcgttcgacatcgcgctgcacctgcagaacacatatctctctaataatcccccctcctcttcctccaatgacccctcctccgccgccgctggacagcagcagcagcagcagggtcagcttttcccggccgacgggagcgggacggtagcgcttcaccgcgcgttcaacgcgttcgtcgaccagatcttcagccagtacggcgccccgctcgccggcttctacatgccgctcgatccgcggacggccgagtccgacaaggcggcctttgtccggcggattccgggggtgacaagatgggaagatctagagatccccaagggctccgaggtgaggagcaagatgctggccgagttcgagagcgctttggacaccaagctcgggccctgctttccgtctcctgcccccgccgacggagctaagggaggaccgcaggggactggtcctttcatggacggacgccagctccccatctacgccgacttcatcgtcggcggctggctgcagtttatgcggggatgcctgcccgagtgggaggatatgcgcaacaagtggtccggcggcaagtggggaaggctgcttgatgcgttggaaccgtgggcggacgtcgatgggcgcgagggcgtcgttccggcgaggcgatgattgcggctgatgtcggccgctgggaatcaacgcctggatgggagactgttcgaattcaattcaattgatttcgtaaacaaggaaagaaagaagacgatgagatagaaatagaacaatattgaaagaaaaccgacaaggaagaaaataa

SEQ ID NO: 116 - protein, 1106 aa, Chrysosporium lucknowense
MRFLPSTLLLAAAALAADKGRPSLKNAVYKNPKASVEDRVADLLSRMTIEEKASQLLQGDIRNWMNETTNALNQTGLEWSTRYRGSAFYVGVPVPNEWLTKHIKAAQDYIQKETYLGIPAFVQTEGLHGFLAHNATIFSSPIGLGCSWNPSLVEEMAAAIAKEARALGVNQLFAPVADLARELRHGRVEEMYSEDGLLAGEFARAYVKGAQSAGVSAMVKHFAAFGVTEQGLNTGPVHGGERELRTTYLPPYQRAIIDGGVYSIMTAYHSYDGIPAVSDPHLLTDILRDEWGYGYFTMTDAGASDRLCADFKMCASDPIDKEAIVKYILPAGGDVEMGGGSYSFEKIPELVSSGKVEEELVDTAVARVLRAKFELGLFENPFPGLPSEEANKVIHAPEHVALAKKLDEESIVLLENHNNVLPLSKDASVAVIGPMAHGFMNYGDYVVVNSSTRGITPLDGIKAASRGKVTYAKGCERWSNSQDGFPEAVAAAEAADVAVVVVGTWSRDQNELWQGLNATTGEHVDVDSLDLVGAQEALVRAIVETGKPTVVVFSSGKPVTAPSISEHAAALVQQFYPSEQGGAALASILFGDVNPSGRLSVSFPRSVGDLPVYYDYLNSGRGASPDAGVAYENGTLVFGHQYVLGDPRPLYEFGYGLSYSKFEYGDVTVDKTIVTAQDTVTVTVTVKNVSSREGQEVVQVYVKDLIASVVVPNIRLRGFQKLKLRPGESKRVSIKVNVQDLGVWDARMRYVVEPGDFLFLVGKTPLRYTDWIRQTFFGHNSRNSHPDPLTCSLSDLPTMDTSNNKVITFYDIILDPTAYPISPNPWKTRYALNFAKVPYRTTWVPLAAVAETRNALQLPANRKHADGSDFPTLPIIRDPLAATTSGSEVVVGDSFDIALHLQNTYLSNNPPSSSSNDPSSAAAGQQQQQQGQLFPADGSGTVALHRAFNAFVDQIFSQYGAPLAGFYMPLDPRTAESDKAAFVRRIPGVTRWEDLEIPKGSEVRSKMLAEFESALDTKLGPCFPSPAPADGAKGGPQGTGPFMDGRQLPIYADFIVGGWLQFMRGCLPEWEDMRNKWSGGKWGRLLDALEPWADVDGREGVVPARR

SEQ ID NO: 117 - DNA, 3318 bp, Chrysosporium lucknowense
atgaggttcctcccctcgacgttgcttcttgcggcggccgccctggctgccgacaaggggcgcccgagtctcaagaatgctgtgtacaagaaccccaaagcctcggtcgaggaccgtgtagccgaccttctctcccgaatgaccatcgaggagaaggcatcccagcttctccaaggtgacatccgcaactggatgaacgagacgaccaatgcgctcaaccagaccggtctggaatggagcaccagataccgggggagcgccttttatgtaggcgtccccgttcccaatgagtggctcacaaagcacatcaaggccgcccaggattacatccagaaggagacctacctgggtatcccggcctttgttcagaccgagggtcttcacggttttcttgctcacaatgccaccatcttcagctcgcccataggactcggctgctcatggaacccgtccctggttgaggagatggcggctgccattgccaaagaggcgcgcgcccttggcgtcaaccagctctttgccccggtcgccgacctcgcgcgggaactccgccacggccgtgtcgaggagatgtacagcgaggacggcctcctcgccggcgagttcgcccgtgcctatgtcaagggcgcgcagtcggccggtgtcagtgccatggtcaagcactttgccgcctttggcgtgacggagcagggcttgaacacggggcccgtccacggcggcgaacgagagctgcgcacaacctatctgccgccctaccagcgcgccatcatcgacggaggggtctattccatcatgacggcctaccacagctacgacggcatccccgccgtgtccgacccccacctgctcaccgacatcctccgggacgaatggggttacggatacttcaccatgacagacgccggcgcctcggaccgcctctgcgccgacttcaagatgtgcgcctcggatcccatcgacaaggaagccatcgtcaagtacatcctcccggccggcggcgacgtggagatgggaggcgggtcgtactcgttcgagaagatccccgagctggtgtccagcggcaaggtcgaggaggagctcgtcgataccgccgtcgcccgcgtccttcgggccaagtttgagctcggcctcttcgagaaccccttcccgggcctcccgtccgaggaggcgaacaaggtgatccacgcgcccgagcacgtcgccctggcgaagaagctggacgaggagtccatcgtcctcctggagaaccacaacaacgtcctgccgctgagcaaggatgcgtccgtggccgtcatcggacccatggcgcacggattcatgaactacggcgactacgtcgtcgtcaactcttcgacccgcgggatcacgcccctcgacggcatcaaggcggccagccggggcaaggtcacgtacgcgaaaggctgcgagcgctggtccaactcgcaagacgggtttcccgaggccgtcgcggccgccgaggccgccgacgtcgccgtcgtcgtggtcggcacctggtctcgggaccagaacgagctctggcagggcctgaacgccaccacgggcgagcacgtcgacgtggacagcctcgacctggttggcgcccaggaggccctcgtccgcgccatcgtcgagacgggcaagccgaccgtggtcgtcttctcgtccggcaagcccgtcaccgcgccgtcgatctcggagcacgccgccgccctcgtccagcagttctacccctcggagcagggaggcgccgccctcgcctccatcctcttcggcgacgtgaacccgagcggcaggctcagcgtcagcttcccccgcagcgtcggcgacctgccggtctactacgactacttgaactcgggacgcggcgcctcgcctgatgcgggcgtcgcttacgagaacggcactctggtgtttgggcatcagtacgtcctgggtgacccgaggcctctgtacgagttcggttacgggctgagttactccaagttcgagtacggcgacgtcactgtcgacaagacgatcgtgacggcccaagacaccgtcaccgtcaccgtcaccgtcaagaacgtgtcgagtcgggaaggtcaggaggtcgtccaggtctacgtcaaggacctgatcgccagcgtcgtcgttcccaacattcggctgaggggattccagaagctgaagctgaggccgggagagagcaagcgagtgagcatcaaggtcaacgtacaggacctgggcgtctgggacgcgaggatgcgatacgttgttgagcccggcgactttctgttcctcgttggtaagacacctctgcggtacacggattggatcaggcaaaccttcttcggacacaactcgagaaattcacaccctgatcctcttacctgcagtttgtcggatttgccaaccatggacacctctaacaacaaagtcatcacgttttacgacatcatcctcgatccgacggcctaccctatctcaccaaacccgtggaagacgcgctacgcgctcaactttgccaaggtgccctatcgcacgacttgggtgccccttgctgccgtcgcagagacgcggaacgcgctgcaactccctgccaaccggaagcatgccgacggcagcgacttccccacgcttcccatcatccgcgacccgctcgccgcgactacgtccgggtccgaggtcgtcgtgggcgattcgttcgacatcgcgctgcacctgcagaacacatatctctctaataatcccccctcctcttcctccaatgacccctcctccgccgccgctggacagcagcagcagcagcagggtcagcttttcccggccgacgggagcgggacggtagcgcttcaccgcgcgttcaacgcgttcgtcgaccagatcttcagccagtacggcgccccgctcgccggcttctacatgccgctcgatccgcggacggccgagtccgacaaggcggcctttgtccggcggattccgggggtgacaagatgggaagatctagagatccccaagggctccgaggtgaggagcaagatgctggccgagttcgagagcgctttggacaccaagctcgggccctgctttccgtctcctgcccccgccgacggagctaagggaggaccgcaggggactggtcctttcatggacggacgccagctccccatctacgccgacttcatcgtcggcggctggctgcagtttatgcggggatgcctgcccgagtgggaggatatgcgcaacaagtggtccggcggcaagtggggaaggctgcttgatgcgttggaaccgtgggcggacgtcgatgggcgcgagggcgtcgttccggcgaggcga

SEQ ID NO: 118 - DNA, 3474 bp, Chrysosporium lucknowense
  CDS (377)..(630)
  CDS (784)..(1211)
  CDS (1294)..(3368)
agtagttataccgaaccaacactacaagcgtggtcccctcccgccgatccgccgactgccatgtgcttgggttagcccctgcaaatcccggagccgaatgtaacggtccgcccattcgcgggacgcctgacctagtagggcgctccggtctcgaccttggtcaagggggggagcaggtcgtgagaagggccgagtgagatcgtccctttaagacgcgtcgaatgactggtcttgtcgtctttgtcctcctgttggcgtgcgcctggtctctcaaccacagccgaccggaatagttcaaatcggcgggcctgcttgcctgcctccctgtacttcctgtttgacttgggagcgcgaaggtctagacggcgcggtcgagatggtttaccgcgcgagcgccgtttggctctcgctggttctcagcctctctgctcccccaacgctcgcccgtaccattgggccgagagacaaggtcccagaaggattctatgcggctccctactaccccacgccgcacggcgggtggcttgattcgtggaaggatgcgtatgcaaaggcccacgccttggtgtctcggatgactttggctgagaagaccaacatcacgtctggcgtcggcatcttcatgggtatgtagtagagaccccctgaataaggcggccctcacctctctctttatgttcttatctccagcatctcatgtcgctaaaatgttgtcctcacagggtcggtccaagagcacgtttctcttccacgccttcattttgctgactaggaggtatgcaggccatgtgtgggaaacacgggaagcgccgaccgcctgagcttcccccagctctgccttcaagactcggcgcttggggtggcatccgccgacaacgtcaccgctttcccacccggcatcaccaccggggcgacgtgggataaggccctgatgtacgcccgcggagttgctattggcagggagttccgcggcaagggggccaacgtccatctcggcccctccgttggccccattggacggaagccactcggcggccggaactgggaagggttcggcgccgacccggtgctgcaggccaaggcggccgccttgcacattaagggcgtccaggagcagggtgttatcgcgaccgtcaagcatctgatcgggaacgagcaggagatgttccgcatgtacaacccgttccagcccgggtacagcgccaacattggtgagaaggacggattcctcggagcgccaccagctccgccggcgtgctcccgtacagcgctgtgctgaccaaaagttgctagacgaccggacgctccatgagttgtacctgtggccgttcgccgaggccgtccacgccggcgtcggcgcggtcatgaccgcctacaatgccgtgaacgggtccgcctcgtcgcagaatagctacctgatcaacggcctcctcaaggacgagctcggcttccagggcatggtcatgtcagactggctcagtcacatctcgggcgtcggctcggctctggccggtctcgacctcaacatgccgggcgacaccaacgtcccgctctttggcttcagcctgtggcagtacgagctgaccaggtccgtcctgaacggctccgtgcccctagataggctgaatgacatggctacccgggtggtggcggcctggtataagatgaggcaggacaaggatttcccacggcccaacttctcgtccaacacgcgggaccggaacgggctcctgtacccggccgccatcttctctcccatcggccaggtcaactggttcgttaacgtccaggaggaccactacaagatcgctcgccaggtcgcccaggatgccattacgctcctcaagaacgacggcagccttctgccgctgacgggctcgggaaagatcaccgtcttcgggaccggcgcgcaggtcaaccccgcggggccgaacgcctgtctgaacagggcgtgcaacaagggcaccctcggcatgggctggggctcgggcgtggccgactacccctacttcgacgaccccatcacggccatcaggaagagggtcccggacgtcgagttccacaacagcgacgagttcccgctcttcttcacgggcgaggcgccggcccccgacgacgtcgccgtcgtcttcatcagctcggacgcgggcgagaacagcttcacggtcgagaacaaccacggcgaccgcgacgcggacaagctggcagcctggcacggcggtgacgggctggtcaagaaggtggccgacaagttcccgaacgtggtcgtcgtcgcccacacggtggggccgctcatcctcgagccctggatcgaccacccttccgtcaaggccgtcctcttcgcccacctcccgggccaggaggcgggcgagtcgctggccggcgtcctcttcggcgacgtgtcgccgagcggtcacctcccctactccatcacccgggccgagaccgactaccccgacagcatcgccaagctcaaggggttcaccctcggccaggtccaagacacgtactcggaggggctctacatcgactaccgctggctcaacaagcgctccatcaagccgcgtttcgccttcggccacggcctcagctacaccaccttcgccttcaccaacgccaccattcgcgccgtcaccgcccccctggaccccatcccgccgccgcggccctccaagctgccgaccccgtcctacccgaccgacctgcccgccgcctcggaggcctactacccggacgggttcaagcccatctggcgctatctctactcgtggctgccgaagtccgaggcggacgccgcgtgggccatcggcgccaccggcaagcagaagtacgcttacccggacgggtactcaaccacgcagaagcccgggccggcggcgggcgggggcgagggcggccacccggcgctgtgggacgtggcgtgggaggtcgacgtgacggtgaccaacgcggccggcagcggcgccaacatcagctccgcggcggagaagaagacgacgggtggtgtcggcggccccggcgggctgccccggttcttccccggcccggcgcgggcctcggtgcaggcgtacgtgcagtacccgccgggcatcccgtacgacacgccgccggtgcagctgcgcgactttgagaagacgccccccctggcgcccggcgagagccagacggtcacgctgcggctgacgcgcaaggacgtcagcgtctgggacgtcgagctgcagaactgggtcgtccccggggcgacgctcgggggaggagggaaaggcccgggcaggtacaccatctggatcggcgaggccagtgatcagctgttcctggcctgttatacggataccggcaagtgcgagcaggggctggagccgcccgtctgagaggatcccatagtcaagaatgtaaatactgtttgacagggaagagttggatgaagggaagaacgcacatgtgtcgtagtcggcggctgtggggggtaatata

SEQ ID NO: 119 - protein, 919 aa, Chrysosporium lucknowense
MVYRASAVWLSLVLSLSAPPTLARTIGPRDKVPEGFYAAPYYPTPHGGWLDSWKDAYAKAHALVSRMTLAEKTNITSGVGIFMGMPCVGNTGSADRLSFPQLCLQDSALGVASADNVTAFPPGITTGATWDKALMYARGVAIGREFRGKGANVHLGPSVGPIGRKPLGGRNWEGFGADPVLQAKAAALHIKGVQEQGVIATVKHLIGNEQEMFRMYNPFQPGYSANIDDRTLHELYLWPFAEAVHAGVGAVMTAYNAVNGSASSQNSYLINGLLKDELGFQGMVMSDWLSHISGVGSALAGLDLNMPGDTNVPLFGFSLWQYELTRSVLNGSVPLDRLNDMATRVVAAWYKMRQDKDFPRPNFSSNTRDRNGLLYPAAIFSPIGQVNWFVNVQEDHYKIARQVAQDAITLLKNDGSLLPLTGSGKITVFGTGAQVNPAGPNACLNRACNKGTLGMGWGSGVADYPYFDDPITAIRKRVPDVEFHNSDEFPLFFTGEAPAPDDVAVVFISSDAGENSFTVENNHGDRDADKLAAWHGGDGLVKKVADKFPNVVVVAHTVGPLILEPWIDHPSVKAVLFAHLPGQEAGESLAGVLFGDVSPSGHLPYSITRAETDYPDSIAKLKGFTLGQVQDTYSEGLYIDYRWLNKRSIKPRFAFGHGLSYTTFAFTNATIRAVTAPLDPIPPPRPSKLPTPSYPTDLPAASEAYYPDGFKPIWRYLYSWLPKSEADAAWAIGATGKQKYAYPDGYSTTQKPGPAAGGGEGGHPALWDVAWEVDVTVTNAAGSGANISSAAEKKTTGGVGGPGGLPRFFPGPARASVQAYVQYPPGIPYDTPPVQLRDFEKTPPLAPGESQTVTLRLTRKDVSVWDVELQNWVVPGATLGGGGKGPGRYTIWIGEASDQLFLACYTDTGKCEQGLEPPV

SEQ ID NO: 120 - DNA, 2757 bp, Chrysosporium lucknowense
atggtttaccgcgcgagcgccgtttggctctcgctggttctcagcctctctgctcccccaacgctcgcccgtaccattgggccgagagacaaggtcccagaaggattctatgcggctccctactaccccacgccgcacggcgggtggcttgattcgtggaaggatgcgtatgcaaaggcccacgccttggtgtctcggatgactttggctgagaagaccaacatcacgtctggcgtcggcatcttcatgggtatgccatgtgtgggaaacacgggaagcgccgaccgcctgagcttcccccagctctgccttcaagactcggcgcttggggtggcatccgccgacaacgtcaccgctttcccacccggcatcaccaccggggcgacgtgggataaggccctgatgtacgcccgcggagttgctattggcagggagttccgcggcaagggggccaacgtccatctcggcccctccgttggccccattggacggaagccactcggcggccggaactgggaagggttcggcgccgacccggtgctgcaggccaaggcggccgccttgcacattaagggcgtccaggagcagggtgttatcgcgaccgtcaagcatctgatcgggaacgagcaggagatgttccgcatgtacaacccgttccagcccgggtacagcgccaacattgacgaccggacgctccatgagttgtacctgtggccgttcgccgaggccgtccacgccggcgtcggcgcggtcatgaccgcctacaatgccgtgaacgggtccgcctcgtcgcagaatagctacctgatcaacggcctcctcaaggacgagctcggcttccagggcatggtcatgtcagactggctcagtcacatctcgggcgtcggctcggctctggccggtctcgacctcaacatgccgggcgacaccaacgtcccgctctttggcttcagcctgtggcagtacgagctgaccaggtccgtcctgaacggctccgtgcccctagataggctgaatgacatggctacccgggtggtggcggcctggtataagatgaggcaggacaaggatttcccacggcccaacttctcgtccaacacgcgggaccggaacgggctcctgtacccggccgccatcttctctcccatcggccaggtcaactggttcgttaacgtccaggaggaccactacaagatcgctcgccaggtcgcccaggatgccattacgctcctcaagaacgacggcagccttctgccgctgacgggctcgggaaagatcaccgtcttcgggaccggcgcgcaggtcaaccccgcggggccgaacgcctgtctgaacagggcgtgcaacaagggcaccctcggcatgggctggggctcgggcgtggccgactacccctacttcgacgaccccatcacggccatcaggaagagggtcccggacgtcgagttccacaacagcgacgagttcccgctcttcttcacgggcgaggcgccggcccccgacgacgtcgccgtcgtcttcatcagctcggacgcgggcgagaacagcttcacggtcgagaacaaccacggcgaccgcgacgcggacaagctggcagcctggcacggcggtgacgggctggtcaagaaggtggccgacaagttcccgaacgtggtcgtcgtcgcccacacggtggggccgctcatcctcgagccctggatcgaccacccttccgtcaaggccgtcctcttcgcccacctcccgggccaggaggcgggcgagtcgctggccggcgtcctcttcggcgacgtgtcgccgagcggtcacctcccctactccatcacccgggccgagaccgactaccccgacagcatcgccaagctcaaggggttcaccctcggccaggtccaagacacgtactcggaggggctctacatcgactaccgctggctcaacaagcgctccatcaagccgcgtttcgccttcggccacggcctcagctacaccaccttcgccttcaccaacgccaccattcgcgccgtcaccgcccccctggaccccatcccgccgccgcggccctccaagctgccgaccccgtcctacccgaccgacctgcccgccgcctcggaggcctactacccggacgggttcaagcccatctggcgctatctctactcgtggctgccgaagtccgaggcggacgccgcgtgggccatcggcgccaccggcaagcagaagtacgcttacccggacgggtactcaaccacgcagaagcccgggccggcggcgggcgggggcgagggcggccacccggcgctgtgggacgtggcgtgggaggtcgacgtgacggtgaccaacgcggccggcagcggcgccaacatcagctccgcggcggagaagaagacgacgggtggtgtcggcggccccggcgggctgccccggttcttccccggcccggcgcgggcctcggtgcaggcgtacgtgcagtacccgccgggcatcccgtacgacacgccgccggtgcagctgcgcgactttgagaagacgccccccctggcgcccggcgagagccagacggtcacgctgcggctgacgcgcaaggacgtcagcgtctgggacgtcgagctgcagaactgggtcgtccccggggcgacgctcgggggaggagggaaaggcccgggcaggtacaccatctggatcggcgaggccagtgatcagctgttcctggcctgttatacggataccggcaagtgcgagcaggggctggagccgcccgtc

SEQ ID NO: 121 - DNA, 3048 bp, Chrysosporium lucknowense
  CDS (30)..(1678)
  CDS (1779)..(3033)
acacgcaaggcaattcaagtcgatacacgatggctcgcgacgggagccatcaagggctcctccgcgattctaagcggtcgccccaacgccccaaggacgacgccggccatgattccgactccgacattgaagcgatcgagtatcttgaccgcaacgcacctcgatcacccaagtccgactacggcccgtcgtttcccgcggcaaacaaagcacgtcaatcgtggatcctccgttgcctggggcggcggagccggtgttgcatcggttttttggctggcttcatcgggctgtggatcttgctaagcgcgggaggtgccttcgtctacaagaaatatcaggaagagcctccctatggccagtcgcccccgtggtacccggcccctaagggcggcattgccaagacgtgggccgagagttatgagaaggcggccaagatggtgagcaagatgacgctggcggaaaaggtcaatgtcacgaccgggacagggtggcagatgggccttgcggttggcaccaacggtccggccgtccacgtgggcttcccgcaactgcagttgcaggacgggccgttgggcatcaggttcgccgataacatcaccgcctttcccgcaagcatcacggtaggcgcaacctggaatcgccagttgatgtacgcgcgtggccgtgctcacggcatcgaagcgcgccaaaagggcattaacgtccttctgggcccctgcgtgggccccctcggccgtatgcccgccggcgggcgcaactgggaaggattcggggccgatccgtacctgcagggcgtggcgggtgccgagacggtcaagggcatccagagcgagggcgtcatggccacaattaagcacttcgtcggaaacgagcaggagcacttccgccagccgtgggagtggggcctgccccatgccctcagtgccaacatcgacgaccgtaccctgcacgagctgtatgtttggcccttcgccgacgcagtcaaagccggcgtcgcctccgtcatgtgctcctacaacatggtcaacaactcgtacgcctgcggcaacagcaagttgctcaatggcatcctcaaggacgagatgggcttccagggtttcgtcatgagcgactggcttgcccagcgctccggggtggcctcggccctggcgggtctggacatgaccatgcccggcgatggcgcgaagtgggccagcggagagtcgttttggggacccgagctgagcagggcggtcctgaacggcagcgtccccgtcgatcgcctgaacgacatggtcacccgaatcgttgcggcctggtaccagctggggcaggacgacgagaccaagttcccgcgccagccgcccaacttctcgtcctggaccgatgaccgcaccggcgtcctggcgcccgggagcccgagcccgcaggagaaggtcgtggtcaaccagttcgtggacgtgaaggcgaaccactccgtcatcgcccgcgaagtggccgtccagggcacggtgctgctcaagaatgagggattgctgcctattagccgcactggcctagacgaggcggaactcgaggcgagacgtggcgctgctgcgagagcgacaggaagaagacgcaccggaaagttcagcgttggcgtgtttggggacgacgctgggcccgggaaaggacccaactactgcaaggatcgtgcttggtatgtcgatccctccatcaaaccgtttcctagtcgaaagagaggagcagtctacgccgtcgatccaagcatcacacacgtagaaactaacacattgtagtaaccaaggcacgctggcttcgggctggggttccggggccgtcgagttcccttatttagtatcgcccattgatgcgctccgcaaggagttcgacagctccaaagtcgagctgcacgagcatctgacagataagccatccttcgccggcaaggacgcggcggtccttgaagacctggaactctgcatcgtcttcgtgaacgccgacgcgggcgagggattcgtccggtgggaggacgtcaagggagatcggccgaacctaaacctccagaaaggcggcgacgacctcattgtcaacgtagcatccaagtgcggttctggctccggcgacgtcattgttgtcgtccatgcggtagggccggtgctgatggagaagtggatcgagctgcccaacatcaaagctgttctcttcgccaacctccccggccaagaatctggaaatgcgcttgccgacgtcctcttcggcaaggccaatccgtcaggccatctgcccttcaccattggcaaatccccggaggattacggtcctggcggcaaggtcatgtacctgccaaacggcgtcgttccccagcaggatttctcggagggtctgtacgtggactaccgctactttgacaagaaggatatcgagccccggttcgagttcggcttcggcctcagttacaccaccttcaacctgagcaaccttcgcgtcacgtcgcacaagaacaagtcggccctgccggcagcccggccgagccccgccgcgcaaccaccaagctacccgaccgccatcccgcccaaggacgaagccatgttccccccggggttccgcgcgctggagaagtatatttacccgtatctcgagtcggtggatgacatcgaggtcggagactacccgtatcccgacggctacgacacggagcagcccctgagcggcgccgggggcgatgagggcggcaaccctgacttgtgggcgacctacgtgactgtctcggcggacgtcaagaacgatggccccgtggccggcgccgtggtgccgcagctatatctagagtatcccgccaaggagggggtggatttccccgtccgggtgctccggggattcgaaaagttctatctcgaaccgggcgagacgcacgccgctcgttttaacctgacgaggagggatctgagttactgggatgtcgtggagcagaattgggtcatggtcacggagggagagtacaagtttcgggtcggcttcagttcgagggatttgcctttgacgggcacctggtgatgctctaacaac

SEQ ID NO: 122 - protein, 968 aa, Chrysosporium lucknowense
MARDGSHQGLLRDSKRSPQRPKDDAGHDSDSDIEAIEYLDRNAPRSPKSDYGPSFPAANKARQSWILRCLGRRSRCCIGFLAGFIGLWILLSAGGAFVYKKYQEEPPYGQSPPWYPAPKGGIAKTWAESYEKAAKMVSKMTLAEKVNVTTGTGWQMGLAVGTNGPAVHVGFPQLQLQDGPLGIRFADNITAFPASITVGATWNRQLMYARGRAHGIEARQKGINVLLGPCVGPLGRMPAGGRNWEGFGADPYLQGVAGAETVKGIQSEGVMATIKHFVGNEQEHFRQPWEWGLPHALSANIDDRTLHELYVWPFADAVKAGVASVMCSYNMVNNSYACGNSKLLNGILKDEMGFQGFVMSDWLAQRSGVASALAGLDMTMPGDGAKWASGESFWGPELSRAVLNGSVPVDRLNDMVTRIVAAWYQLGQDDETKFPRQPPNFSSWTDDRTGVLAPGSPSPQEKVVVNQFVDVKANHSVIAREVAVQGTVLLKNEGLLPISRTGLDEAELEARRGAAARATGRRRTGKFSVGVFGDDAGPGKGPNYCKDRACNQGTLASGWGSGAVEFPYLVSPIDALRKEFDSSKVELHEHLTDKPSFAGKDAAVLEDLELCIVFVNADAGEGFVRWEDVKGDRPNLNLQKGGDDLIVNVASKCGSGSGDVIVVVHAVGPVLMEKWIELPNIKAVLFANLPGQESGNALADVLFGKANPSGHLPFTIGKSPEDYGPGGKVMYLPNGVVPQQDFSEGLYVDYRYFDKKDIEPRFEFGFGLSYTTFNLSNLRVTSHKNKSALPAARPSPAAQPPSYPTAIPPKDEAMFPPGFRALEKYIYPYLESVDDIEVGDYPYPDGYDTEQPLSGAGGDEGGNPDLWATYVTVSADVKNDGPVAGAVVPQLYLEYPAKEGVDFPVRVLRGFEKFYLEPGETHAARFNLTRRDLSYWDVVEQNWVMVTEGEYKFRVGFSSRDLPLTGTW

SEQ ID NO: 123 - DNA, 2904 bp, Chrysosporium lucknowense
atggctcgcgacgggagccatcaagggctcctccgcgattctaagcggtcgccccaacgccccaaggacgacgccggccatgattccgactccgacattgaagcgatcgagtatcttgaccgcaacgcacctcgatcacccaagtccgactacggcccgtcgtttcccgcggcaaacaaagcacgtcaatcgtggatcctccgttgcctggggcggcggagccggtgttgcatcggttttttggctggcttcatcgggctgtggatcttgctaagcgcgggaggtgccttcgtctacaagaaatatcaggaagagcctccctatggccagtcgcccccgtggtacccggcccctaagggcggcattgccaagacgtgggccgagagttatgagaaggcggccaagatggtgagcaagatgacgctggcggaaaaggtcaatgtcacgaccgggacagggtggcagatgggccttgcggttggcaccaacggtccggccgtccacgtgggcttcccgcaactgcagttgcaggacgggccgttgggcatcaggttcgccgataacatcaccgcctttcccgcaagcatcacggtaggcgcaacctggaatcgccagttgatgtacgcgcgtggccgtgctcacggcatcgaagcgcgccaaaagggcattaacgtccttctgggcccctgcgtgggccccctcggccgtatgcccgccggcgggcgcaactgggaaggattcggggccgatccgtacctgcagggcgtggcgggtgccgagacggtcaagggcatccagagcgagggcgtcatggccacaattaagcacttcgtcggaaacgagcaggagcacttccgccagccgtgggagtggggcctgccccatgccctcagtgccaacatcgacgaccgtaccctgcacgagctgtatgtttggcccttcgccgacgcagtcaaagccggcgtcgcctccgtcatgtgctcctacaacatggtcaacaactcgtacgcctgcggcaacagcaagttgctcaatggcatcctcaaggacgagatgggcttccagggtttcgtcatgagcgactggcttgcccagcgctccggggtggcctcggccctggcgggtctggacatgaccatgcccggcgatggcgcgaagtgggccagcggagagtcgttttggggacccgagctgagcagggcggtcctgaacggcagcgtccccgtcgatcgcctgaacgacatggtcacccgaatcgttgcggcctggtaccagctggggcaggacgacgagaccaagttcccgcgccagccgcccaacttctcgtcctggaccgatgaccgcaccggcgtcctggcgcccgggagcccgagcccgcaggagaaggtcgtggtcaaccagttcgtggacgtgaaggcgaaccactccgtcatcgcccgcgaagtggccgtccagggcacggtgctgctcaagaatgagggattgctgcctattagccgcactggcctagacgaggcggaactcgaggcgagacgtggcgctgctgcgagagcgacaggaagaagacgcaccggaaagttcagcgttggcgtgtttggggacgacgctgggcccgggaaaggacccaactactgcaaggatcgtgcttgtaaccaaggcacgctggcttcgggctggggttccggggccgtcgagttcccttatttagtatcgcccattgatgcgctccgcaaggagttcgacagctccaaagtcgagctgcacgagcatctgacagataagccatccttcgccggcaaggacgcggcggtccttgaagacctggaactctgcatcgtcttcgtgaacgccgacgcgggcgagggattcgtccggtgggaggacgtcaagggagatcggccgaacctaaacctccagaaaggcggcgacgacctcattgtcaacgtagcatccaagtgcggttctggctccggcgacgtcattgttgtcgtccatgcggtagggccggtgctgatggagaagtggatcgagctgcccaacatcaaagctgttctcttcgccaacctccccggccaagaatctggaaatgcgcttgccgacgtcctcttcggcaaggccaatccgtcaggccatctgcccttcaccattggcaaatccccggaggattacggtcctggcggcaaggtcatgtacctgccaaacggcgtcgttccccagcaggatttctcggagggtctgtacgtggactaccgctactttgacaagaaggatatcgagccccggttcgagttcggcttcggcctcagttacaccaccttcaacctgagcaaccttcgcgtcacgtcgcacaagaacaagtcggccctgccggcagcccggccgagccccgccgcgcaaccaccaagctacccgaccgccatcccgcccaaggacgaagccatgttccccccggggttccgcgcgctggagaagtatatttacccgtatctcgagtcggtggatgacatcgaggtcggagactacccgtatcccgacggctacgacacggagcagcccctgagcggcgccgggggcgatgagggcggcaaccctgacttgtgggcgacctacgtgactgtctcggcggacgtcaagaacgatggccccgtggccggcgccgtggtgccgcagctatatctagagtatcccgccaaggagggggtggatttccccgtccgggtgctccggggattcgaaaagttctatctcgaaccgggcgagacgcacgccgctcgttttaacctgacgaggagggatctgagttactgggatgtcgtggagcagaattgggtcatggtcacggagggagagtacaagtttcgggtcggcttcagttcgagggatttgcctttgacgggcacctgg

SEQ ID NO: 124 - DNA, 3683 bp, Chrysosporium lucknowense
  CDS (217)..(266)
  CDS (559)..(675)
  CDS (768)..(2017)
  CDS (2075)..(3423)
acattgtgctgacatacgtatggtaactttactgcgttagttatggttcctgagagcaagcagcatcagcagtagcagcagtagcaacagcagcagcattgttacacttcaactgctgttggggctttcccggaccattcggcggagcattatgccgccatcgaccgagcaccgttcccgaacccaccgcgccgattgccgcagcccgagcacaacatgagcaccttggatggcgatttggacccactatggcaggacctcgactggtatgtcgtctttgcacttcttatctcttttttccgtttgacgtggtcgtttccgccccgtctgtggcttgacgtgtggcagtgaggttgctgttgctcagcgctcccggtcatcccggaggagtccgtcatcatggcggtcgagcatcaaggcgtggcgaggaatgggatgactgaatgggcggatagctggctggctggctggctggctggttggatggatggatgattaataaatgaattactggacacgattaaggtctattagagacggccgctaacagtgcgtcagggccatcggtcagatgctgattatgggatgggatgggaccgaagtcacaccccagatccgtactctaatcgagcagcatcacctgggctcggtcctgctaacggcaaagaacctcaaatgttgtacacccggccgcctcgcagatgcttgattataatcgaggtcgtatactaaccggaatgcaatgcagccgccgagcaaacggcaagactcgtccaggagctccagaccatcgcccgtcaggccggccatccctaccccctgctgattgccctcgaccaggagaatggcggcgtcaacagcctctttgacgaggactacatctgccagttccccagctccatgggccaggctgccgccagcagtgccgacctggcctacaagatcgccaaggccaccgctaccgaagtctcggccgtcggtgtcaacctgatcttgggaccagtgctggacgtgctcaccaatgcgcgctaccagccgctgggcgtgcgagcgaccggcgacgacccccaagaggtctcccagtacggcatcgccgctatgaacggctacaaggacgccggcgttgccacctgcgggaaacacttcccttcctacggcaacctggattttctcggctccagcttggacatccccatcatcacccagaccctggaggaactctctctgagcgcccttgttcccttccgcaacgccatcgccaccggcaagctggacgccatgtttgtcggtggctgtggcatcgcgaacccgtccatgaacgtcaaccacgcgtgtctgtctgaacaggtggtcgacgacctgctcagaaacgagctcggcttccaaggtgtcgccatctcggagtgtttggagatggagggtctcaggaacgagattggcgtcaaaacgggcacggtcatggcagtcgaggccgggtgcgacttggtcatgctctgtcgcgcctacgatgtgcaactcgaggccatttccggcctgaaactgggcgtggagaatgagctcatcacgaaagagcgcatctacacgtcgctcaggcgaatcgtccgcatgaagaagtcgtgcacttcctggcagaaggcgttgaaccctcccggcatcagcttgctgtccaagatccatccgggccacctcgcactctcgctgaaggcctacgacgactccatcgccgtcatacgagacaacgaaaagctgctccccttgacctcttccatgcaccaggaagaggaactgctgctgctcacgccactggtaaggccgctaccggcttcctccatgaccaaggcgttgctggagaagaaacaaatcgaccccgtaacactccacgacaaatgggtccaccgtgatcggggagccatcatgagcggcgagggagtatttcgcgagctcggaagatccctcgctcgtgcaaggcatgggaagctgctacatacatcttacaccgcgaacggtgtcaggccaggtcagtctcctccccctacgggccctgccgcgctgctccctcctaatgcatgactagtacacgaaaacctcatcaaccgagcctcgtgtatcatcatcgtgacggcggacgccaaccgcaacctgtaccaggcaggctttacaaagcacgtctccatgatgtgctcattgctgagggcaaatgggcagaagaagtcgctcatcgtggttgccgtcagctccccttacgacttcgcgatggacaagtcggtcgggacctacatctgcacctttgacttcaccgagacggctatggccgctctcgtacgggtcttatgcggcaagatcaagccccggggcacactgcccgggaccctcaggaagagcagaaaggtgctcaaatccaggcagcactggctcgtcgagccgtacgaccgcgaccgagacgccaaggggttacaggacctcctacaatccttggccagagcgagcgcgcctgcccaccagttcctgcagaccacgagcgcgcattcctttgagctgttcagccccaacatcgaggaagcccacttcgtagtgcgcaacagcagcactcaggcgctctacggcttctgcgcaacctactttgtccaagggacgggaattatcggcgctctctttgtcgaccccgccaagcgcaatgtctccatcggcaggtccctccaacggcgagccctgcgcggcttgacccagaagcgcggcatcaagaaggtacagctgggcatgtccttcccgggcgtcttcctaggcatccccgcggacgacagcgccgggctcaagcagtggtttaccaacgggggttgggacctgcagttcccacggcgcctcgtcaacatggccgtctcatctctcaacagctggattgcccccgaagggctgctgcagagcatccagcgcgccggcatcaccttcgacctcatccacggcctggacaatgccgacaacgtgctggcccacgtcagcgcacacgcaagcccggaggtgctggagctgtaccgcttcgcgctgcaagagaccaagagctgcggtgtcgtccgggccaagggccacgccgaggcgctgcttggcacggtaatcgtctgcaagcccgggagcaccctggccagcttcatcccgcccctgcagccctctccggcgcggcctgacgagcctgtcggggggatcgtgagcccgatcgtggcgccgtcgtcggctcaggcaaccttggtgctgcagggtctcgccctgatgggcctgcggcagaacaagacgcacaagtcgctaaaaagtgtgctgagctgggtgcaggatgacgcgcatgagccactgttggctatgggattcgaagtggtgcaggtctttgaggagtttacgaattcgccggataatgtgagtgtgtttccctctgcttgacacgtaaagtgtcgtggtcagagagctaagctgactgtttgtagtggcaggacttttcttgatctaagatggcagctagtcttggtgttgtcatggtgaacgcgacttgactcgtagttgagtgggttggacattctttcggcgactgacgcttagatatatgttatgcccggctatatatcccgcagcattattttttttttttttttgatttctctctttcctcgtcaccttggaacctgacacttccaaattaa

SEQ ID NO: 125 - protein, 922 aa, Chrysosporium lucknowense
MSTLDGDLDPLWQDLDWAIGQMLIMGWDGTEVTPQIRTLIEQHHLGSVLLTAKNLKLVQELQTIARQAGHPYPLLIALDQENGGVNSLFDEDYICQFPSSMGQAAASSADLAYKIAKATATEVSAVGVNLILGPVLDVLTNARYQPLGVRATGDDPQEVSQYGIAAMNGYKDAGVATCGKHFPSYGNLDFLGSSLDIPIITQTLEELSLSALVPFRNAIATGKLDAMFVGGCGIANPSMNVNHACLSEQVVDDLLRNELGFQGVAISECLEMEGLRNEIGVKTGTVMAVEAGCDLVMLCRAYDVQLEAISGLKLGVENELITKERIYTSLRRIVRMKKSCTSWQKALNPPGISLLSKIHPGHLALSLKAYDDSIAVIRDNEKLLPLTSSMHQEEELLLLTPLVRPLPASSMTKALLEKKQIDPVTLHDKWVHRDRGAIMSGEGVFRELGRSLARARHGKLLHTSYTANGVRPVHENLINRASCIIIVTADANRNLYQAGFTKHVSMMCSLLRANGQKKSLIVVAVSSPYDFAMDKSVGTYICTFDFTETAMAALVRVLCGKIKPRGTLPGTLRKSRKVLKSRQHWLVEPYDRDRDAKGLQDLLQSLARASAPAHQFLQTTSAHSFELFSPNIEEAHFVVRNSSTQALYGFCATYFVQGTGIIGALFVDPAKRNVSIGRSLQRRALRGLTQKRGIKKVQLGMSFPGVFLGIPADDSAGLKQWFTNGGWDLQFPRRLVNMAVSSLNSWIAPEGLLQSIQRAGITFDLIHGLDNADNVLAHVSAHASPEVLELYRFALQETKSCGVVRAKGHAEALLGTVIVCKPGSTLASFIPPLQPSPARPDEPVGGIVSPIVAPSSAQATLVLQGLALMGLRQNKTHKSLKSVLSWVQDDAHEPLLAMGFEVVQVFEEFTNSPDNVSVFPSA

SEQ ID NO: 126 - DNA, 2766 bp, Chrysosporium lucknowense
atgagcaccttggatggcgatttggacccactatggcaggacctcgactgggccatcggtcagatgctgattatgggatgggatgggaccgaagtcacaccccagatccgtactctaatcgagcagcatcacctgggctcggtcctgctaacggcaaagaacctcaaactcgtccaggagctccagaccatcgcccgtcaggccggccatccctaccccctgctgattgccctcgaccaggagaatggcggcgtcaacagcctctttgacgaggactacatctgccagttccccagctccatgggccaggctgccgccagcagtgccgacctggcctacaagatcgccaaggccaccgctaccgaagtctcggccgtcggtgtcaacctgatcttgggaccagtgctggacgtgctcaccaatgcgcgctaccagccgctgggcgtgcgagcgaccggcgacgacccccaagaggtctcccagtacggcatcgccgctatgaacggctacaaggacgccggcgttgccacctgcgggaaacacttcccttcctacggcaacctggattttctcggctccagcttggacatccccatcatcacccagaccctggaggaactctctctgagcgcccttgttcccttccgcaacgccatcgccaccggcaagctggacgccatgtttgtcggtggctgtggcatcgcgaacccgtccatgaacgtcaaccacgcgtgtctgtctgaacaggtggtcgacgacctgctcagaaacgagctcggcttccaaggtgtcgccatctcggagtgtttggagatggagggtctcaggaacgagattggcgtcaaaacgggcacggtcatggcagtcgaggccgggtgcgacttggtcatgctctgtcgcgcctacgatgtgcaactcgaggccatttccggcctgaaactgggcgtggagaatgagctcatcacgaaagagcgcatctacacgtcgctcaggcgaatcgtccgcatgaagaagtcgtgcacttcctggcagaaggcgttgaaccctcccggcatcagcttgctgtccaagatccatccgggccacctcgcactctcgctgaaggcctacgacgactccatcgccgtcatacgagacaacgaaaagctgctccccttgacctcttccatgcaccaggaagaggaactgctgctgctcacgccactggtaaggccgctaccggcttcctccatgaccaaggcgttgctggagaagaaacaaatcgaccccgtaacactccacgacaaatgggtccaccgtgatcggggagccatcatgagcggcgagggagtatttcgcgagctcggaagatccctcgctcgtgcaaggcatgggaagctgctacatacatcttacaccgcgaacggtgtcaggccagtacacgaaaacctcatcaaccgagcctcgtgtatcatcatcgtgacggcggacgccaaccgcaacctgtaccaggcaggctttacaaagcacgtctccatgatgtgctcattgctgagggcaaatgggcagaagaagtcgctcatcgtggttgccgtcagctccccttacgacttcgcgatggacaagtcggtcgggacctacatctgcacctttgacttcaccgagacggctatggccgctctcgtacgggtcttatgcggcaagatcaagccccggggcacactgcccgggaccctcaggaagagcagaaaggtgctcaaatccaggcagcactggctcgtcgagccgtacgaccgcgaccgagacgccaaggggttacaggacctcctacaatccttggccagagcgagcgcgcctgcccaccagttcctgcagaccacgagcgcgcattcctttgagctgttcagccccaacatcgaggaagcccacttcgtagtgcgcaacagcagcactcaggcgctctacggcttctgcgcaacctactttgtccaagggacgggaattatcggcgctctctttgtcgaccccgccaagcgcaatgtctccatcggcaggtccctccaacggcgagccctgcgcggcttgacccagaagcgcggcatcaagaaggtacagctgggcatgtccttcccgggcgtcttcctaggcatccccgcggacgacagcgccgggctcaagcagtggtttaccaacgggggttgggacctgcagttcccacggcgcctcgtcaacatggccgtctcatctctcaacagctggattgcccccgaagggctgctgcagagcatccagcgcgccggcatcaccttcgacctcatccacggcctggacaatgccgacaacgtgctggcccacgtcagcgcacacgcaagcccggaggtgctggagctgtaccgcttcgcgctgcaagagaccaagagctgcggtgtcgtccgggccaagggccacgccgaggcgctgcttggcacggtaatcgtctgcaagcccgggagcaccctggccagcttcatcccgcccctgcagccctctccggcgcggcctgacgagcctgtcggggggatcgtgagcccgatcgtggcgccgtcgtcggctcaggcaaccttggtgctgcagggtctcgccctgatgggcctgcggcagaacaagacgcacaagtcgctaaaaagtgtgctgagctgggtgcaggatgacgcgcatgagccactgttggctatgggattcgaagtggtgcaggtctttgaggagtttacgaattcgccggataatgtgagtgtgtttccctctgct

SEQ ID NO: 127 - DNA, 1384 bp, Chrysosporium lucknowense
  CDS (126)..(1193)
gtataaaaaaaaaaggaatcatgcccgtactacccgtgtccgctcttgatttcctctctgcccccttcacggacggaacatacagcacgagaaggaacctctacagaccgacgtcctgaaagaacatgaagtggacgagattgtctctcgctacggcctccctcttcggcctcgctgtcgccggatcaaagaacaagatccagatcggccaacaagtcatctactcgtaccccggcgaaacgccgccggagcacctcttcgatctcatcagggcaggccaagtgggcgggctcatcctcttcggcgagaacgtcaacgatgagctccccgcgaccatcgaacagttcctctcggcctaccgcgagagcccggcctacgccgacctcaagacgcccttcctgatcatgaccgaccaggagggcggccaggtccgccgtctgcccggcgcgcccgtggagtcggcgaaggaggtgggcgagtcggcggacccagtcgcggccgcgggccgggcgggcgccggcgcggcggagacgctgctccggtacaacatgaacgcgaacctcgcgcccgtcctggacgtctaccgggaggagggcgacttcacggacaattacgagcggtcgttcagcaacgacgcgacggtggtggccgggtgcgcggcgcagttcgtccgggaccagcagcgcgccaaggtcctcgcgacggcgaagcacttccccggcctgggcgccgccaagaaggacgagaacacggatgcgcgccccgtcaccatcgacctgacgctggaggagatccgcgcggtcgacgaggtcccctatcacgacgcgatcggcgccggcatcgccatgatcatgccgtcctgggccatctacccggcctttgacgccgagcggccggccgggctgagctcacgctggatacgagacgagctgcgcggaaggctgggcttcgacggcgtcattgtcaccgacgcgatcgaggccgggtccctgaaggcgtttggcgacgacgccgatcgggcgttgctggccaagaaggctggcgtggatctgattcttgcgtcggggaggaatgtgactcagggggagagcatcgtttctgcgttggccgccgcgctggagaatggagacctgtcgcagcaagagttggacgcgtcggacaagagggtacaggcggcccgggcgaagctcgcatagctggggagctccgaaccgatgtcggtgtctcgggagtctgtatcatctgtatatcccgtccttggcctctgcgagggcctcctctggatgtggtagattcgaggaatagaaaatcaggcgcctcacccggtttgcttggtgggaccaggctgcggttcgctgcggatgatgatgtgacatgccgccca

SEQ ID NO: 128 - protein, 356 aa, Chrysosporium lucknowense
MKWTRLSLATASLFGLAVAGSKNKIQIGQQVIYSYPGETPPEHLFDLIRAGQVGGLILFGENVNDELPATIEQFLSAYRESPAYADLKTPFLIMTDQEGGQVRRLPGAPVESAKEVGESADPVAAAGRAGAGAAETLLRYNMNANLAPVLDVYREEGDFTDNYERSFSNDATVVAGCAAQFVRDQQRAKVLATAKHFPGLGAAKKDENTDARPVTIDLTLEEIRAVDEVPYHDAIGAGIAMIMPSWAIYPAFDAERPAGLSSRWIRDELRGRLGFDGVIVTDAIEAGSLKAFGDDADRALLAKKAGVDLILASGRNVTQGESIVSALAAALENGDLSQQELDASDKRVQAARAKLA

SEQ ID NO: 129 - DNA, 1068 bp, Chrysosporium lucknowense
atgaagtggacgagattgtctctcgctacggcctccctcttcggcctcgctgtcgccggatcaaagaacaagatccagatcggccaacaagtcatctactcgtaccccggcgaaacgccgccggagcacctcttcgatctcatcagggcaggccaagtgggcgggctcatcctcttcggcgagaacgtcaacgatgagctccccgcgaccatcgaacagttcctctcggcctaccgcgagagcccggcctacgccgacctcaagacgcccttcctgatcatgaccgaccaggagggcggccaggtccgccgtctgcccggcgcgcccgtggagtcggcgaaggaggtgggcgagtcggcggacccagtcgcggccgcgggccgggcgggcgccggcgcggcggagacgctgctccggtacaacatgaacgcgaacctcgcgcccgtcctggacgtctaccgggaggagggcgacttcacggacaattacgagcggtcgttcagcaacgacgcgacggtggtggccgggtgcgcggcgcagttcgtccgggaccagcagcgcgccaaggtcctcgcgacggcgaagcacttccccggcctgggcgccgccaagaaggacgagaacacggatgcgcgccccgtcaccatcgacctgacgctggaggagatccgcgcggtcgacgaggtcccctatcacgacgcgatcggcgccggcatcgccatgatcatgccgtcctgggccatctacccggcctttgacgccgagcggccggccgggctgagctcacgctggatacgagacgagctgcgcggaaggctgggcttcgacggcgtcattgtcaccgacgcgatcgaggccgggtccctgaaggcgtttggcgacgacgccgatcgggcgttgctggccaagaaggctggcgtggatctgattcttgcgtcggggaggaatgtgactcagggggagagcatcgtttctgcgttggccgccgcgctggagaatggagacctgtcgcagcaagagttggacgcgtcggacaagagggtacaggcggcccgggcgaagctcgca

SEQ ID NO: 130 - DNA, 2305 bp, Chrysosporium lucknowense
  CDS (307)..(1845)
ctataaacaacaagcctccgactactcggccctgtctcacactggttcgtgtgctctttccggaaccactcggttggtgctgtgagagccagtccacctgcgtctctcatactggtcgccactcagacactgtgtgcagcaccgcatgggagtcgagcacgacctcagcgactattggtgccagcccggcggttccaggttgtgtcgtcctgccccaaggggtgtcaataagtcagtggagctatcctcggttgacctctcttcatgagtgcgcctcccactgacttgactgaccaggtttaccttatgccccttgtgttgctctgcccttcccttcatagctctgggcttgtttcagcaagcttcttttctgtgccttccccagctgctcctgttccaacgcctacccatgaaatggagctcagcaggcggcaggacatagtctcgactgtccaagatctccagtcatgcatccccctttcgaaccagctacaggatggcgacatcattttgttactgacgcctgggatcgtgcccgagctgagccctctaaaccgcaatcccgatgaaccgaccagagatccttttgaacccctcgggaaagctctggctaggcaccacccctgggttcatcatgtcccgtacctgccacgaaacgggattaccggcactcacgtcgtgcacatcaggctagcggctgttgtgatttttgtcatctcaggccctccgcgtcatggacagcagtcgcaagtggctttagcggaaatcactcgatccgtctgcgagtcccggcctcaaatcatcctgacctgctgtgagctgcaaggactaggacctctcgaagaatccttccccacgatattagaggtgcccagcttcgttccgtcagatttggaggaggccgccgacgtcctctttcagtcgaagagacctagtcccgggccgttggacatacgagacccggtattgtcgccgagagcctggcccgtcgaggtatgggacggaattcgtgacatgtccgaagtgctcgacctgtggtgtcagtgtcttccgaaaaactttcaccttggccgctaccagttccagtcattgctctgccgcgacggttatgccatgcactatgtcgtgcgagaaccggggacttggcaacttctaggcttctgtgcaacctatacaacatatgccgacagcgacggtgagcgtctgttgggatctcttgccgcccttctcgtgcgtccgtcacaccgccagcggggcattggccggagcctacacgaccatgctctgcgccagctcaagaggatacgcggcgtttgccgccttcggcttggtagtacatttcctcggctcctctacgggctcccgatcgactcgcccttcgaaggctggttccggcgccgcggatggccgataaccctcccctcctcggccgtaagctcggagcaagaagcatgtgactggtttctcaaattcaaggactggccagtgacgggcccgacgccgtccgagctcacgttccgcccttgcatgttctcggagttcgacctggtgctggagtttgtggacaaggagtcgtgtaagaaggacaacatggggtggtacgaccagtacgccaagctcgccaatacgatgaacattcaggatattgtcctgggccttgatgggggcactatcattgcagtggctttgacttacgtcaagaacaccgggagcccggcggccgaagaccttccctgggccagcaccattgcagacgacgttgggggtgtcacatgtgtatgtgtcagtggtacgtattccgccatcgacgggcgttctgaaggaggaggtgtgggtgtatgcgtatagatgctgacgggagttctggtttgtagatgaggtgcccaatacggcaaacaagcgggacgcggtcatgattaggcttcttgacagttgcatccgcctgctcagcgagcaagggatgaataagctgctcattgatgccgtcaaaggaggagacgagggatttcagtcaatgggtgagtccgtttccaggcctggcaattttgtaactcgcacaaccgtgctgacacggagcatcaggctttcagaaatgggcgaggtaccgagacgtttggcggtgtgtttgaaaaccggcggtattccgtttcttggcgcggacaggaggcgagatgggagcccagcttgggggagcactgcacctgcctcgagcggtgcgaaggcgaggaccagcccgagctcagcatctgtttgctgggctgacgcgagcggcctgctttggaagctgtggtctcatggctgtcga

SEQ ID NO: 131 - protein, 513 aa, Chrysosporium lucknowense
MPLVLLCPSLHSSGLVSASFFSVPSPAAPVPTPTHEMELSRRQDIVSTVQDLQSCIPLSNQLQDGDIILLLTPGIVPELSPLNRNPDEPTRDPFEPLGKALARHHPWVHHVPYLPRNGITGTHVVHIRLAAVVIFVISGPPRHGQQSQVALAEITRSVCESRPQIILTCCELQGLGPLEESFPTILEVPSFVPSDLEEAADVLFQSKRPSPGPLDIRDPVLSPRAWPVEVWDGIRDMSEVLDLWCQCLPKNFHLGRYQFQSLLCRDGYAMHYVVREPGTWQLLGFCATYTTYADSDGERLLGSLAALLVRPSHRQRGIGRSLHDHALRQLKRIRGVCRLRLGSTFPRLLYGLPIDSPFEGWFRRRGWPITLPSSAVSSEQEACDWFLKFKDWPVTGPTPSELTFRPCMFSEFDLVLEFVDKESCKKDNMGWYDQYAKLANTMNIQDIVLGLDGGTIIAVALTYVKNTGSPAAEDLPWASTIADDVGGVTCVCVSGTYSAIDGRSEGGGVGVCV

SEQ ID NO: 132 - DNA, 1539 bp, Chrysosporium lucknowense
atgccccttgtgttgctctgcccttcccttcatagctctgggcttgtttcagcaagcttcttttctgtgccttccccagctgctcctgttccaacgcctacccatgaaatggagctcagcaggcggcaggacatagtctcgactgtccaagatctccagtcatgcatccccctttcgaaccagctacaggatggcgacatcattttgttactgacgcctgggatcgtgcccgagctgagccctctaaaccgcaatcccgatgaaccgaccagagatccttttgaacccctcgggaaagctctggctaggcaccacccctgggttcatcatgtcccgtacctgccacgaaacgggattaccggcactcacgtcgtgcacatcaggctagcggctgttgtgatttttgtcatctcaggccctccgcgtcatggacagcagtcgcaagtggctttagcggaaatcactcgatccgtctgcgagtcccggcctcaaatcatcctgacctgctgtgagctgcaaggactaggacctctcgaagaatccttccccacgatattagaggtgcccagcttcgttccgtcagatttggaggaggccgccgacgtcctctttcagtcgaagagacctagtcccgggccgttggacatacgagacccggtattgtcgccgagagcctggcccgtcgaggtatgggacggaattcgtgacatgtccgaagtgctcgacctgtggtgtcagtgtcttccgaaaaactttcaccttggccgctaccagttccagtcattgctctgccgcgacggttatgccatgcactatgtcgtgcgagaaccggggacttggcaacttctaggcttctgtgcaacctatacaacatatgccgacagcgacggtgagcgtctgttgggatctcttgccgcccttctcgtgcgtccgtcacaccgccagcggggcattggccggagcctacacgaccatgctctgcgccagctcaagaggatacgcggcgtttgccgccttcggcttggtagtacatttcctcggctcctctacgggctcccgatcgactcgcccttcgaaggctggttccggcgccgcggatggccgataaccctcccctcctcggccgtaagctcggagcaagaagcatgtgactggtttctcaaattcaaggactggccagtgacgggcccgacgccgtccgagctcacgttccgcccttgcatgttctcggagttcgacctggtgctggagtttgtggacaaggagtcgtgtaagaaggacaacatggggtggtacgaccagtacgccaagctcgccaatacgatgaacattcaggatattgtcctgggccttgatgggggcactatcattgcagtggctttgacttacgtcaagaacaccgggagcccggcggccgaagaccttccctgggccagcaccattgcagacgacgttgggggtgtcacatgtgtatgtgtcagtggtacgtattccgccatcgacgggcgttctgaaggaggaggtgtgggtgtatgcgta

SEQ ID NO: 133 - DNA, 1708 bp, Chrysosporium lucknowense
  CDS (73)..(1464)
agaatctgtttcccagagtcgcggtcagacagtcgaaccagaaggtaataattattacaaagacacaacacgatggggcagaagactctccaggggctggtggcggcggcggcactggcagcctcggtggcgaacgcgcagcaaccgggcaccttcacgcccgaggtgcatccgacgctgccgacgtggaagtgcacgacgagcggcgggtgcgtccagcaggacacgtcggtggtgctcgactggaactaccgctggttccacaccgaggacggtagcaagtcgtgcatcacctctagcggcgtcgaccggaccctgtgcccggacgaggcgacgtgcgccaagaactgcttcgtcgagggcgtcaactacacgagcagcggggtcgagacgtccggcagctccctcaccctccgccagttcttcaagggctccgacggcgccatcaacagcgtctccccgcgcgtctacctgctcgggggagacggcaactatgtcgtgctcaagctcctcggccaggagctgagcttcgacgtggacgtatcgtcgctcccgtgcggcgagaacgcggccctgtacctgtccgagatggacgcgacgggaggacggaacgagtacaacacgggcggggccgagtacgggtcgggctactgtgacgcccagtgccccgtgcagaactggaacaacgggacgctcaacacgggccgggtgggctcgtgctgcaacgagatggacatcctcgaggccaactccaaggccgaggccttcacgccgcacccctgcatcggcaactcgtgcgacaagagcgggtgcggcttcaacgcgtacgcgcgcggttaccacaactactgggcccccggcggcacgctcgacacgtcccggcctttcaccatgatcacccgcttcgtcaccgacgacggcaccacctcgggcaagctcgcccgcatcgagcgcgtctacgtccaggacggcaagaaggtgcccagcgcggcgcccgggggggacgtcatcacggccgacgggtgcacctccgcgcagccctacggcggcctttccggcatgggcgacgccctcggccgcggcatggtcctggccctgagcatctggaacgacgcgtccgggtacatgaactggctcgacgccggcagcaacggcccctgcagcgacaccgagggtaacccgtccaacatcctggccaaccacccggacgcccacgtcgtgctctccaacatccgctggggcgacatcggctccaccgtcgacaccggcgatggcgacaacaacggcggcggccccaacccgtcatccaccaccaccgctaccgctaccaccacctcctccggcccggccgagcctacccagacccactacggccagtgtggagggaaaggatggacgggccctacccgctgcgagacgccctacacctgcaagtaccagaacgactggtactcgcagtgcctgtagaggccggatcctctctgactgggtcccgaccggggacgtgtcttgaggaagaagggagagggcatcgaggttcattgtacatagtagataggtatctttccgaatagtatgtacatacatacatgggtacataaggtatatacgtagcatatgaacgaaccttggtgcgttatttcgtgctcgatatgtggtgattatgcatattttatgatgtgatccttgcaggcctcgatctaattaa

SEQ ID NO: 134 - protein, 464 aa, Chrysosporium lucknowense
MGQKTLQGLVAAAALAASVANAQQPGTFTPEVHPTLPTWKCTTSGGCVQQDTSVVLDWNYRWFHTEDGSKSCITSSGVDRTLCPDEATCAKNCFVEGVNYTSSGVETSGSSLTLRQFFKGSDGAINSVSPRVYLLGGDGNYVVLKLLGQELSFDVDVSSLPCGENAALYLSEMDATGGRNEYNTGGAEYGSGYCDAQCPVQNWNNGTLNTGRVGSCCNEMDILEANSKAEAFTPHPCIGNSCDKSGCGFNAYARGYHNYWAPGGTLDTSRPFTMITRFVTDDGTTSGKLARIERVYVQDGKKVPSAAPGGDVITADGCTSAQPYGGLSGMGDALGRGMVLALSIWNDASGYMNWLDAGSNGPCSDTEGNPSNILANHPDAHVVLSNIRWGDIGSTVDTGDGDNNGGGPNPSSTTTATATTTSSGPAEPTQTHYGQCGGKGWTGPTRCETPYTCKYQNDWYSQCL

SEQ ID NO: 135 - DNA, 1392 bp, Chrysosporium lucknowense
atggggcagaagactctccaggggctggtggcggcggcggcactggcagcctcggtggcgaacgcgcagcaaccgggcaccttcacgcccgaggtgcatccgacgctgccgacgtggaagtgcacgacgagcggcgggtgcgtccagcaggacacgtcggtggtgctcgactggaactaccgctggttccacaccgaggacggtagcaagtcgtgcatcacctctagcggcgtcgaccggaccctgtgcccggacgaggcgacgtgcgccaagaactgcttcgtcgagggcgtcaactacacgagcagcggggtcgagacgtccggcagctccctcaccctccgccagttcttcaagggctccgacggcgccatcaacagcgtctccccgcgcgtctacctgctcgggggagacggcaactatgtcgtgctcaagctcctcggccaggagctgagcttcgacgtggacgtatcgtcgctcccgtgcggcgagaacgcggccctgtacctgtccgagatggacgcgacgggaggacggaacgagtacaacacgggcggggccgagtacgggtcgggctactgtgacgcccagtgccccgtgcagaactggaacaacgggacgctcaacacgggccgggtgggctcgtgctgcaacgagatggacatcctcgaggccaactccaaggccgaggccttcacgccgcacccctgcatcggcaactcgtgcgacaagagcgggtgcggcttcaacgcgtacgcgcgcggttaccacaactactgggcccccggcggcacgctcgacacgtcccggcctttcaccatgatcacccgcttcgtcaccgacgacggcaccacctcgggcaagctcgcccgcatcgagcgcgtctacgtccaggacggcaagaaggtgcccagcgcggcgcccgggggggacgtcatcacggccgacgggtgcacctccgcgcagccctacggcggcctttccggcatgggcgacgccctcggccgcggcatggtcctggccctgagcatctggaacgacgcgtccgggtacatgaactggctcgacgccggcagcaacggcccctgcagcgacaccgagggtaacccgtccaacatcctggccaaccacccggacgcccacgtcgtgctctccaacatccgctggggcgacatcggctccaccgtcgacaccggcgatggcgacaacaacggcggcggccccaacccgtcatccaccaccaccgctaccgctaccaccacctcctccggcccggccgagcctacccagacccactacggccagtgtggagggaaaggatggacgggccctacccgctgcgagacgccctacacctgcaagtaccagaacgactggtactcgcagtgcctg

SEQ ID NO: 136 - DNA, 2170 bp, Chrysosporium lucknowense
  CDS (139)..(294)
  CDS (417)..(875)
  CDS (978)..(1185)
  CDS (1317)..(1671)
  CDS (1816)..(2005)
gtataaagggagcggtcccttcccgccgtcaggatcttgaggagaagaggaaccagcgcagtgctgatcccgtccagctcagtcctcccactcagcccctccctcctcatccactacacccagtccagtctgcccaccatgtaccggcaggtcgcgaccgctctctccttcaccagcctcgtgctcggccagcaagcgggaaccctcaccgaggagatccacccctcgcttcccatcgaggtgtgcacagctcccggctcgtgcactaaggaggacaccaccgtggtcctggacgtaagtggccatcccacagacggactcccatgtggcctcgtcgtctcttttggaggggatacacggcatagcataagaaaaaagtggctaactgacgcctcttcctcctctcctcgacctaggccaactggcgctggacacacgtcaccgacggctacaccaactgctacacgggcaacgcctggaacgagacggcctgccccgacggcgtgacgtgcgcggccaactgcgccatcgacggcgccgactacgagggcacgtacggtatcacgacgccgtccgatggcgcactcaagctcaactttgtcaccaagaaccagaacggccagaacgtcggctcgcgcgtctacctgatgaagggtgacgacaagtaccgcctcttcaacctgctcaacaaggagttcacctttgacgttgacgtgtccaacctgccctgcggcctgaacggcgctgtctatttcagcgagatggacgaggacggcggcatgtcccgcttcgagggcaacaaggccggcgccaagtacggcaccggctactgcgacagccagtgcccgcaggacatcaagtttatcaacggcgaggtacggccttttttcttcttctttcccttgatgttgaaaaaaaaaaaaaaacataaagggccatggtggtgatccgggcggccagctgacacaaagaaacaggccaacaccgagggctggggcggcactgacggaaactccggcaccggcaagtacggcacctgctgcgccgagatggacatctgggaggccaactcagacgccaccgcctacactccgcacccgtgcaaggttaacgagcagacccggtgcgagagtgaggaggagtgcggtgcgggagacaaccggtacgccggcctgtgcgacaagggtacgtgtcagctcttaacttttcccctcaatttgcaaaacgaaaaaaaaaaaaaaaaaaacaatggaaagaatagaataggatgaagaaagaatgggagtagcaagcgacaggactgacatcgcgggcagatggctgcgacttcaacagcttccgcctgggaaacaaggagttctacggcccaggcatgacggtcgacacgagcaagcccttcacggtggtaacgcagttcatcactgacgacaacaccgacacgggcgccctcaaggagatccgccgcttctacgtgcaggacggcaccgtgatccccaactcgcagaccgtcatcgaaggcgtcgaccccaccaactccatcacggacgagttttgcgagcagcagaagacggcctttggcgacaccaactacttcaagacggtcggtggcctgtccgccatgggcaagtcgctcgagaagatggtgctcgtcctcagcgtttgggatgatcagtacgatttcccccttccctttgcccgtttccttttccatttatccctttccccttccttcacccactttctcgccccattcgtcccgtgatgcccaatcttcgggatagaaaacatggttgacaccgctcccttctttctcagtgccgccgccatgaactggctggacagcaactaccccaccgatggcgacccgtccaagcccggtgttgcccgtggccgttgcgacgccgaggccgggctgcccgagaatgtcgaggccgagcaccccgacgcctcggtcacttactccaacatcaagatcggcgccatcaactcgaccttcaccgccgcttagagagacgagagactgatgcgagaatggcagttgataggagaggccaaggggaagaaaagccggggttaaatagatccgggaacatagaacgctagattctttcatgaccgggtgggctttgtactttacatagatgggattcaaggggctcattgcacgtaa

SEQ ID NO: 137 - protein, 456 aa, Chrysosporium lucknowense
MYRQVATALSFTSLVLGQQAGTLTEEIHPSLPIEVCTAPGSCTKEDTTVVLDANWRWTHVTDGYTNCYTGNAWNETACPDGVTCAANCAIDGADYEGTYGITTPSDGALKLNFVTKNQNGQNVGSRVYLMKGDDKYRLFNLLNKEFTFDVDVSNLPCGLNGAVYFSEMDEDGGMSRFEGNKAGAKYGTGYCDSQCPQDIKFINGEANTEGWGGTDGNSGTGKYGTCCAEMDIWEANSDATAYTPHPCKVNEQTRCESEEECGAGDNRYAGLCDKDGCDFNSFRLGNKEFYGPGMTVDTSKPFTVVTQFITDDNTDTGALKEIRRFYVQDGTVIPNSQTVIEGVDPTNSITDEFCEQQKTAFGDTNYFKTVGGLSAMGKSLEKMVLVLSVWDDHAAAMNWLDSNYPTDGDPSKPGVARGRCDAEAGLPENVEAEHPDASVTYSNIKIGAINSTFTAA

SEQ ID NO: 138 - DNA, 1368 bp, Chrysosporium lucknowense
atgtaccggcaggtcgcgaccgctctctccttcaccagcctcgtgctcggccagcaagcgggaaccctcaccgaggagatccacccctcgcttcccatcgaggtgtgcacagctcccggctcgtgcactaaggaggacaccaccgtggtcctggacgccaactggcgctggacacacgtcaccgacggctacaccaactgctacacgggcaacgcctggaacgagacggcctgccccgacggcgtgacgtgcgcggccaactgcgccatcgacggcgccgactacgagggcacgtacggtatcacgacgccgtccgatggcgcactcaagctcaactttgtcaccaagaaccagaacggccagaacgtcggctcgcgcgtctacctgatgaagggtgacgacaagtaccgcctcttcaacctgctcaacaaggagttcacctttgacgttgacgtgtccaacctgccctgcggcctgaacggcgctgtctatttcagcgagatggacgaggacggcggcatgtcccgcttcgagggcaacaaggccggcgccaagtacggcaccggctactgcgacagccagtgcccgcaggacatcaagtttatcaacggcgaggccaacaccgagggctggggcggcactgacggaaactccggcaccggcaagtacggcacctgctgcgccgagatggacatctgggaggccaactcagacgccaccgcctacactccgcacccgtgcaaggttaacgagcagacccggtgcgagagtgaggaggagtgcggtgcgggagacaaccggtacgccggcctgtgcgacaaggatggctgcgacttcaacagcttccgcctgggaaacaaggagttctacggcccaggcatgacggtcgacacgagcaagcccttcacggtggtaacgcagttcatcactgacgacaacaccgacacgggcgccctcaaggagatccgccgcttctacgtgcaggacggcaccgtgatccccaactcgcagaccgtcatcgaaggcgtcgaccccaccaactccatcacggacgagttttgcgagcagcagaagacggcctttggcgacaccaactacttcaagacggtcggtggcctgtccgccatgggcaagtcgctcgagaagatggtgctcgtcctcagcgtttgggatgatcatgccgccgccatgaactggctggacagcaactaccccaccgatggcgacccgtccaagcccggtgttgcccgtggccgttgcgacgccgaggccgggctgcccgagaatgtcgaggccgagcaccccgacgcctcggtcacttactccaacatcaagatcggcgccatcaactcgaccttcaccgccgct

SEQ ID NO: 139 - DNA, 1746 bp, Chrysosporium lucknowense
  CDS (261)..(780)
  CDS (883)..(1124)
  CDS (1215)..(1292)
atattaaacagcctcaaaaccttctccatccgctcctttgtcttctctcgtctctgcaccgacgttccttctccagcagagagacatatacatacacattccttcggctgcattccagcggaatcttcgattcatcttctcccttccttgtacatactttgacgagctgtatcctcgcatacagccttgttcttcgctctccttttttgcattcttgaatctattctcccacttctttgctcgtgtctcccgacgccgcaatgcacttcacttcgtacctctcggttctgtccgtcctgggcaccagcggcggcgtcctggcctgggcaccccccagctacgacgggtacaggctggtctggtcggacgcgttcccgggcgcccccgggacgctgccgaacgagaacaactggaacatcatcacgggcaacctgggcgtcaacaacgagctcgaggtctaccagcgggacccgcgcaacctgcagatgagcggcggcaacacgctgcagatcgtcccctggctcgacggctccacctggtcctcgggccggatcgagtccaagtacaccttcacgccccagcccggcggccgcaccatggccgaggcccagatccgcttcggctccaacgacatcagcaccaagcagggcctctggcccgccttctggctgctcggcgactccatccgccacggcaccggctggcccgcgtgcggcgagctcgacattttggagaccatcaacggccagctgacgggctacggaaccgcccactgcaccggttcgtcatccctccccccccccccctttttttttcatgtttctttataatatggacagcaaagaaactgacttgtatggccatgtccggaaccgggaacagcctgcaatgaacccgtcggtcgcggtggctcggtccccatccccaatcaggacttccagcggtggcggatcgtctgggacctcaccaatggcgactggcgcgcccagaccatcacctggttcatgaacgaccagcagttccaccagctcagcggtgctaccatcggagaccagggcgtctggtccaccctgactaacaagccgctcttcttcatcctcaacatggccgtcggcggcaactgggtgagttctttgaccctctgcaagagagagagaaagagagagagacgaggtggtgtgacctgatgtgctgacgaatccgatccgtcgtagcccggctatcccaacgacaggacccagggtggctacggagccatgatggaggtgggctatgttgctcattactcgacctagggttgctgctcaataccctaccgcccgttgttgtgctccgtggtcaacaattcgcttgatatacccccttaaccccttgacgcatgcgtttctgttcatgtatatattttgatctacttcatcttgtgttttgccgttggacttggtgtcggaggcatctcactcaaccataccagcatgttggcaatttgacttggtgtgctatgctttttgatgtcgtttttacattcttaaggtgccttgtacatcatttcaagcagattcacctgttgttccctcaatatgagtcatcagctgattgggcccccgtctctggcgttccaaccacagaagctaggcacattgtgaaacgaagttggaagactcgaacaacagaaggaggctttgcagcggtggttggcttcgaaggttcaactaagtgccttgtagtagttacctaagaaagagagta

SEQ ID NO: 140 - protein, 280 aa, Chrysosporium lucknowense
MHFTSYLSVLSVLGTSGGVLAWAPPSYDGYRLVWSDAFPGAPGTLPNENNWNIITGNLGVNNELEVYQRDPRNLQMSGGNTLQIVPWLDGSTWSSGRIESKYTFTPQPGGRTMAEAQIRFGSNDISTKQGLWPAFWLLGDSIRHGTGWPACGELDILETINGQLTGYGTAHCTACNEPVGRGGSVPIPNQDFQRWRIVWDLTNGDWRAQTITWFMNDQQFHQLSGATIGDQGVWSTLTNKPLFFILNMAVGGNWPGYPNDRTQGGYGAMMEVGYVAHYST

SEQ ID NO: 141 - DNA, 840 bp, Chrysosporium lucknowense
atgcacttcacttcgtacctctcggttctgtccgtcctgggcaccagcggcggcgtcctggcctgggcaccccccagctacgacgggtacaggctggtctggtcggacgcgttcccgggcgcccccgggacgctgccgaacgagaacaactggaacatcatcacgggcaacctgggcgtcaacaacgagctcgaggtctaccagcgggacccgcgcaacctgcagatgagcggcggcaacacgctgcagatcgtcccctggctcgacggctccacctggtcctcgggccggatcgagtccaagtacaccttcacgccccagcccggcggccgcaccatggccgaggcccagatccgcttcggctccaacgacatcagcaccaagcagggcctctggcccgccttctggctgctcggcgactccatccgccacggcaccggctggcccgcgtgcggcgagctcgacattttggagaccatcaacggccagctgacgggctacggaaccgcccactgcaccgcctgcaatgaacccgtcggtcgcggtggctcggtccccatccccaatcaggacttccagcggtggcggatcgtctgggacctcaccaatggcgactggcgcgcccagaccatcacctggttcatgaacgaccagcagttccaccagctcagcggtgctaccatcggagaccagggcgtctggtccaccctgactaacaagccgctcttcttcatcctcaacatggccgtcggcggcaactggcccggctatcccaacgacaggacccagggtggctacggagccatgatggaggtgggctatgttgctcattactcgacc

SEQ ID NO: 142 - DNA, 1324 bp, Chrysosporium lucknowense
  CDS (127)..(570)
  CDS (674)..(1114)
  CDS (1192)..(1284)
atataaatgcctcctatcacccacattccttccccctacacccgctgatcagttggtttccgttcagcacgcaaagccgaagagtttaatccaacgcagtgtccgtaggtcctttcctcaacagacatgaaggccaatctcctggtcctcgcgccgctggccgtctcggcagcgcccgcgctcgagcaccgccaggcaactgagagcatcgacgcgctcattaaggccaagggcaagctctactttggcacctgtaccgaccagggccggctgacgtcgggcaagaacgcggacatcatcagggccaacttcggccaggtgacgcccgagaacagcatgaagtggcagagcatcgagccatcgcggggtcagttcacctggggccaggctgactacctcgtcgactgggccactcagaacaacaagaccatccgcggccacacgctcgtctggcactcgcagctcgccggctacgttcagcagatcggcgaccggaacaccttgacccagaccatccaggaccacattgccgccgtcatgggccgctacaagggcaagatctacgcctgggtacgctcttcccttttcctcgcctcccttcccctcttccccctttccccccccctctggaatgatggaacctccggatttctgacattatttgaaacgttaggatgtcatcaacgagatgttcaacgaggatggctcgcttcgcagcagcgtcttctccaacgtcctcggagaggactttgttgggatcgccttcaaggcggcgcgcgaggccgaccccgacaccaagttgtacatcaacgactacaacctcgacagccccaactacgccaagctgaccaacggcatggtcgctcacgtcaagaagtggctcgcggccggcatccccatcgacggcatcggcacccagggtcacctgcagtctggccagggttccggtcttgcgcaggccatcaaggctctcgcccaggctggcgtcgaggaggttgccgtcaccgagctcgatatccagaaccagaacaccaacgactacactgccgttgtccagggctgcttggacgagcccaagtgcgtcggtatcaccgtctggggtgtccgcgatcccgtaagttcttccttttcatttcttcgcgagcaagctgaagaagggtgtgagcgagcggactaatcttgcaccgataggactcgtggcgtccccagggcaaccccttgctcttcgacagcaacttcaaccccaaggcgaactacaatgccatcgtccagctcctcaagcagtagtcgccacgtccgtaggcgccggaaagatcgaacggga

SEQ ID NO: 143 - protein, 326 aa, Chrysosporium lucknowense
MKANLLVLAPLAVSAAPALEHRQATESIDALIKAKGKLYFGTCTDQGRLTSGKNADIIRANFGQVTPENSMKWQSIEPSRGQFTWGQADYLVDWATQNNKTIRGHTLVWHSQLAGYVQQIGDRNTLTQTIQDHIAAVMGRYKGKIYAWDVINEMFNEDGSLRSSVFSNVLGEDFVGIAFKAAREADPDTKLYINDYNLDSPNYAKLTNGMVAHVKKWLAAGIPIDGIGTQGHLQSGQGSGLAQAIKALAQAGVEEVAVTELDIQNQNTNDYTAVVQGCLDEPKCVGITVWGVRDPDSWRPQGNPLLFDSNFNPKANYNAIVQLLKQ

SEQ ID NO: 144 - DNA, 978 bp, Chrysosporium lucknowense
atgaaggccaatctcctggtcctcgcgccgctggccgtctcggcagcgcccgcgctcgagcaccgccaggcaactgagagcatcgacgcgctcattaaggccaagggcaagctctactttggcacctgtaccgaccagggccggctgacgtcgggcaagaacgcggacatcatcagggccaacttcggccaggtgacgcccgagaacagcatgaagtggcagagcatcgagccatcgcggggtcagttcacctggggccaggctgactacctcgtcgactgggccactcagaacaacaagaccatccgcggccacacgctcgtctggcactcgcagctcgccggctacgttcagcagatcggcgaccggaacaccttgacccagaccatccaggaccacattgccgccgtcatgggccgctacaagggcaagatctacgcctgggatgtcatcaacgagatgttcaacgaggatggctcgcttcgcagcagcgtcttctccaacgtcctcggagaggactttgttgggatcgccttcaaggcggcgcgcgaggccgaccccgacaccaagttgtacatcaacgactacaacctcgacagccccaactacgccaagctgaccaacggcatggtcgctcacgtcaagaagtggctcgcggccggcatccccatcgacggcatcggcacccagggtcacctgcagtctggccagggttccggtcttgcgcaggccatcaaggctctcgcccaggctggcgtcgaggaggttgccgtcaccgagctcgatatccagaaccagaacaccaacgactacactgccgttgtccagggctgcttggacgagcccaagtgcgtcggtatcaccgtctggggtgtccgcgatcccgactcgtggcgtccccagggcaaccccttgctcttcgacagcaacttcaaccccaaggcgaactacaatgccatcgtccagctcctcaagcag

SEQ ID NO: 145 - DNA, 1308 bp, Chrysosporium lucknowense
  CDS (95)..(345)
  CDS (440)..(854)
ttataagaacccagcagcttagtgtcctcaacccggttcgtggcctttgcctcttcgtgtccaagttgtccgactaattaggtcgctcgtaaatatggtcaagctctctctcatcgcagcgagccttgtggcacctagcgtgcttgcgggtcctctcatcggccccaagacgcaaaccgagagccagctgaacccgcgtcaaggcggctacaactacttccagaattggtccgagggaggcagcaatatccgctgcaacaacggccctgggggttcctacacggccgactggaacagcaggggcggcttcgtctgtggcaagggctggagctatggaggcaatcggtgagtcgctcgcgtgccctgtgaccatataaataaagttcaagtaatcggtcaggactcgggccggacccatgctaacgcctacggaacacagcgccatcacgtacaccggcgaatacaacgccagcggccccggctacctcgccgtctacgggtggacccgcaacccgctgattgaatactacatcatcgaggcccatgccgacctcgcccccaacgagccgtggacatccaagggtaatttcagcttcgaggagggcgagtacgaggtcttcaccagcacccgcgtcaacaagccgtccatcgagggcaccaggacttttcagcagtactggtcgctgcgcaaggagcagcgggtcggcggcaccgtcaccacccagaggcactttgaagagtgggccaagctgggcatgaagctgggcaatcatgactatgtcatcctggcgaccgaaggatacactgccaacggaggatccggtagcagcgggcactcgagcattactctgcagtaggcgctgatatttataataggttgcttgctgctggggtgggtgagacaagagttgcatgtcaaacacgttagcaaaatggaatcattcaatctctctacaaaacctgaaaatgttctgtcaacgcgagattgattaagcagagtgcgctgtgtccttgcagacgagcaaacttcaagctttgtccatatacctggtagtgtacgccggatgatgacatggaaaatcggaaaataggacccggaactctagagggagaaaagtcaggccaagtccggatggttatggtcaggtcacccatgaacaccaggagtatgttccgagttgacattcctaccctaaccctggatctgaaacaataatatccatgatgacgcgggcacgcgcaagcacagcgcggggcagagagcgagacctggtaaaacaccagcccacggcccttgacattttttag

SEQ ID NO: 146 - protein, 222 aa, Chrysosporium lucknowense
MVKLSLIAASLVAPSVLAGPLIGPKTQTESQLNPRQGGYNYFQNWSEGGSNIRCNNGPGGSYTADWNSRGGFVCGKGWSYGGNRAITYTGEYNASGPGYLAVYGWTRNPLIEYYIIEAHADLAPNEPWTSKGNFSFEEGEYEVFTSTRVNKPSIEGTRTFQQYWSLRKEQRVGGTVTTQRHFEEWAKLGMKLGNHDYVILATEGYTANGGSGSSGHSSITLQ

SEQ ID NO: 147 - DNA, 666 bp, Chrysosporium lucknowense
atggtcaagctctctctcatcgcagcgagccttgtggcacctagcgtgcttgcgggtcctctcatcggccccaagacgcaaaccgagagccagctgaacccgcgtcaaggcggctacaactacttccagaattggtccgagggaggcagcaatatccgctgcaacaacggccctgggggttcctacacggccgactggaacagcaggggcggcttcgtctgtggcaagggctggagctatggaggcaatcgcgccatcacgtacaccggcgaatacaacgccagcggccccggctacctcgccgtctacgggtggacccgcaacccgctgattgaatactacatcatcgaggcccatgccgacctcgcccccaacgagccgtggacatccaagggtaatttcagcttcgaggagggcgagtacgaggtcttcaccagcacccgcgtcaacaagccgtccatcgagggcaccaggacttttcagcagtactggtcgctgcgcaaggagcagcgggtcggcggcaccgtcaccacccagaggcactttgaagagtgggccaagctgggcatgaagctgggcaatcatgactatgtcatcctggcgaccgaaggatacactgccaacggaggatccggtagcagcgggcactcgagcattactctgcag

SEQ ID NO: 148 - DNA, 3782 bp, Chrysosporium lucknowense
  CDS (1482)..(1729)
  CDS (1849)..(2269)
actcaagtaattagatgccggctaaagtgggaagaacgggtccttgcaggaaacgtccgccctgcgtcgcatcgacctgggagacgtacctgggtacattcctcgcgagctagacaatgccaaggtaagtgtggacgtggtagtgcgtacatacagagtactacctacgctacgctatagatcttgactgccgcggtgctacgtaacctgcttatacggggcagctaagcgcggtctctaggtaccttgctagacacagtacactgctcggtttctctgtacatctctctgtacatacatacactgacttagcactaattacaaacacggcaggaggctcgcaagtccgggtatcgtccagaaatatagtagaagaacaaacctctctgagttcccatgcgccggggcatccggttggagatctacacggttatctgtcgtgtcccctgccgcccatcattccccatcaccgcgatcaacactggcggcgatcacggccgaaccgaaccgttcaggctgtcacggctgttcaagaggtgcaaggtgtggccgcccatagccgcactcaagcgccgttgatccggccgttaaccgcctgtagaagaaggggtgcgaggcgatattggccaagaagcttggcgttttctctagattgttctccgggccaccccagcgacaatgttactatgtatgatacgctggtggtgtggtccattcgcaaattcttcccttgctcaactccattgggccaaggagccaaggtagccctgttccgcggcagtgagcgaaacaagcgttgcccagaggtcgtcatgcatccgaaacgaccccttcgccgttctggtgccggagggttggattgggtaaaaagcgggtcatctgtaacaccacgcgatattcctcagagctactccctactggatacgggtatctcggagcctgccatttagcgagactggccccggttccggcaaagcccgcgccgctttggcggagaccccgttcggctccccttcaccaacgatgcgcgcacgacgccgatcactcgggaccgccattcaggctaaatcacgagtccccttatgcggctccctgggaaggggatcggcgcccgggccccgttcgcgacctcccgaaccgtgctacccgggcttccgagagagcagcccagcagccagcgccggaccatgcaacccatgccaactcagtgcgcgttctctcttatgtgtcctagcacgcggaaccatcccgagatcccatcgagccagggccctcccggtcgtccaatccgggcaaaaaagggagaaacaacgcctggcaggctatctgtatatactacagtaatatatatatatatatatatatatatgaccactagatcctcttcacctccgcccgtcccctctcctcgacaccgccaaaccataacctagactcgcatcatccctctcaacaccgcgagatcgcacggaatcgcaaccatggtttctgtcaaggcagtcctcctcctcggcgccgccggcaccaccctggccttcccgttcaacgctacccagttcagcgagctcgttgcccgggccggcaccccgagcggcaccggcacgcacgacggcttctactactccttctggaccgacggcggcggcaacgtcaactacgagaacggtcctggcggctcctacaccgtccagtggcagaactgcggcaactttgtcggcggcaagggctggtacgtgaatctgaaagcaaggaagagaaacaaaagacagagagagagggggggggagagagggggggggagagagagagagggagtaggtgactaaagatgaaacacccggtctacaggaaccccggccaggcccgcaccatcacctactcgggcaccgtcgacttccagggcggcaacggctacctggccatctacggctggacgcagaacccgctgatcgagtactacatcgtcgagtcgttcggctcgtacgacccctcgtcgcaggcccagactttcggcaccgtcgaggtggacggcggcacctacacgctggccaagacgacgcgcgtcaaccagccctcgatcgagggcaccagcaccttcgaccagttctggtccgtccgccagcagcaccgcacctccggctccgtcgacgtcggcgcccacttcgacgcctgggccaaggccggcctccagctcggcacccacaactaccagatcgtcgccaccgagggctaccagagcagcggctcctcttccatcaccgtccaggcctaagagggccctcaggcctttgctctactgccctctcctctcctctgcgctttccgtaagggagatctaagagagagaaaggtgaagaaattggggggtggtgaggaaggggtatgtgaagttgttagggaacgcgggatatggtcgaacctggaagagtgattttcgcctatccattatctttcgattcgaaatttgacgcgggacgtagtacatgatatctcctgctttctgcgcttgagttcaagcctctcgtagtgacccgagcacgaacatggctgtacatacatacacacctccatacctctccccctgccctgctgtgctccgcgctgaatcaacgtgggctctctgactcgaaacagcaggtcatatttcttgctcgtacctctaaatgccatgagtaagtctttggtgagacacacttctcatgaaggagaggcacgagacttaatcttgtccagttgtacaaattcgcaagcaactagaagcccgcgaggaaaagctacattcaaccacaaaacgcccacccgccggcacgtgaagcatccttgttgattcgtggtgaattggttcagagttgttcaacgtggcactcacccgccctccctcgttgacagttctgtgccatcccgcggtcgtcagagagggctgcacccttcgtccagttagttagacatcgattgcttaaataaactgtgctggttcagcaacatgtcgcatcaataagccgcacaacgcgctaaagggtatggcagtagccggaatattaacgagcgtcctcacacgcgccctccccgataacaagatgatgattgatgaggcatttcttgtaattagtgtacgaattagacacgcctgggcttcaaggacgctgcaccgggttcttgaatcccttaagtcgtataacaacattgaaaagaataagagagcaacaaaaagttcgagatgagctcatcagcaaccatttgcccacaaccagaatcgaactggtgaccttgtcattactagtgacacgctctaccactgagccatgcgggctgcaagctgattggctcatcgatgtttgcagcgcatcgagagcatgaatgtcccgaataatgattgttgaacgctctccgtaaatggctgtaatatcagttagggatgactccgacattgataagaaggcttggctcattgggagagccaaagtcccgaaaacagtctctccagaacgcacagcatccagaaatgggtgggttgacacgtgcccgtcgcgatattaaaattgttcgccttgactgataaaatcttggggtaactaattatgcttttgaccattgttagttttctcctctagctatagctaagaatggtgttatccgacctggatccacgaatgcttgtttccccggtctcctactaattaatagcaatcagggtcagtcaccgaccccgaaccagatctgatcttcccaaccctaaacgcccaggctgtcgtcgcattcaatgcaaaggaaaaaaataccga

SEQ ID NO: 149 - protein, 223 aa, Chrysosporium lucknowense
MVSVKAVLLLGAAGTTLAFPFNATQFSELVARAGTPSGTGTHDGFYYSFWTDGGGNVNYENGPGGSYTVQWQNCGNFVGGKGWNPGQARTITYSGTVDFQGGNGYLAIYGWTQNPLIEYYIVESFGSYDPSSQAQTFGTVEVDGGTYTLAKTTRVNQPSIEGTSTFDQFWSVRQQHRTSGSVDVGAHFDAWAKAGLQLGTHNYQIVATEGYQSSGSSSITVQA

SEQ ID NO: 150 - DNA, 669 bp, Chrysosporium lucknowense
atggtttctgtcaaggcagtcctcctcctcggcgccgccggcaccaccctggccttcccgttcaacgctacccagttcagcgagctcgttgcccgggccggcaccccgagcggcaccggcacgcacgacggcttctactactccttctggaccgacggcggcggcaacgtcaactacgagaacggtcctggcggctcctacaccgtccagtggcagaactgcggcaactttgtcggcggcaagggctggaaccccggccaggcccgcaccatcacctactcgggcaccgtcgacttccagggcggcaacggctacctggccatctacggctggacgcagaacccgctgatcgagtactacatcgtcgagtcgttcggctcgtacgacccctcgtcgcaggcccagactttcggcaccgtcgaggtggacggcggcacctacacgctggccaagacgacgcgcgtcaaccagccctcgatcgagggcaccagcaccttcgaccagttctggtccgtccgccagcagcaccgcacctccggctccgtcgacgtcggcgcccacttcgacgcctgggccaaggccggcctccagctcggcacccacaactaccagatcgtcgccaccgagggctaccagagcagcggctcctcttccatcaccgtccaggcc

SEQ ID NO: 151 - DNA, 4783 bp, Chrysosporium lucknowense
  CDS (2250)..(2301)
  CDS (2436)..(3281)
  CDS (3384)..(3505)
  CDS (3655)..(3748)
  CDS (3830)..(3879)
  CDS (3945)..(4023)
  CDS (4082)..(4314)
  CDS (4400)..(4442)
  CDS (4538)..(4752)
agaaagaataaaaacaaaacttcgcgatcgtacttggccactgttatattagagcgtggaatcatatgattagacagcttgagcctaaacctatagtagagtatattagctgagtcttctgaacctatctcctacttagcttccaggaaaatgtgcgcacaacataagtagttgtctccagttttagatcgccggaacgccaaaaaaattcaaggaattcgagattgcctaaataaagaagctccaacgtcccctcttcagcgaaacgttaatggcgtggaatgtcgcttcaagtcagttgagagaacccgacacttaatttctctggtgcctgaactaacgttttttatccttatactctgccgctttatgagaacaaactccgtatcaatagagaccgagttgatacatgagctgtcaatccaccctcttctcgtctcgacctaagacaggaggagacggagttatcacagccaaagcgggatgcctgtaatctatatggtgttcatacatacctagactggacagcttgatggtattcctcctctctggagttaccacaggttttacctatcgagctttccaccctccccttttttcccccccttgctgctggccgaactaggtcaggtgaggatagcccctaaaagcccaaatataatatatatttattggggctgctgcttcttcatttctagagatggcggatccgcttaacaacagatcggaaagcaagagttgtagacagagagccattatcactacgggcgttggccaacgccagaagataattacatacttccgcaatggcatatatgtgcggacagtaccaatgtgattttgtttcatctatcacgctgccttattcaccgtggcacgagcagctggccagttatgcagggaagcaccaacggattcatggggagctttgtgacgttgctctgcctagagagatgggaccggacataccctccgcggccgccgcaaataatcacaaaatccaaacctcgacacgcctccgagaactcgagacggactgccggacgtctcatcccagcaacgcggattttgccgcgcatcgggaaaagtcagggtagtaacctactgggttgtccttcagccggcaagatcggcggatctaagacgacccccatgattgtcagacacagacctacagaatctttccccaccgtgcccttccacccaccgccctcctcgatttgcttctgactacaggaccaaatgtgtaggtccaggcagacgccgggccagccatcccgacatttctgacaaggctgacagcccctggtccacgcatggtaacctttccctggtcgaataactcaagataccgcccggtgttcgcgggtgaaagtcagggaagccaagaagaggatagagtgcaccatcagtccatgcgagcttccatgcaaccaatcttcactcctcccctgacgttgttcgccaagtagtggtgctgcgtagaaagcccctcccagtgcagaggcagcaatttcatcagcaaatgcaacctcgttcctgcgcccaggccgaggttcaccaataggaaggtgcaagatttaccggacagaccgatatggtaggactgaggacccggcgcgtcagcatcatgaggggaagaggagcgagggggctcggggagaaggcgcgaggtaggaaacctgggaacttaatactatgagcaggctgccagtgtagctttaatctatccccctggctacctgggagggtttccccgctccggtaaatttgagaggatgcaccccgtacatgcttcgttgggtcgagccgtggcgtgcttacagccggtgtgccacgtttttggcgggttcccccagtctcggctaatagaattccccgacttccatttggcagagaagctttcgagaaagaaatctccgcatccgagtctggggaaattgtggaggaggttgcaccaagtaatccgtacttcgagagacaccgtgtgagattcccacgaacccttgtatcctgacaaggggcggtcgtggttctggggaagagcaggggatctatctcgaaagaggggaaacagatctgagttggaaggtttaaagagggttcacaactctgaaatcctcgtccgcatcggtcagatggacgtaaactcagttcgcccactcgcactcgcctgcttctgttgacttcctcgccgagcctatccccttgtctggtctgctgtgtttcggtcgtttgtgtcgggcagcatgcaagttgcttcaaagttggtagccgtcactggcggtgccctggcgctctgtaagtagaggaacaaaccccccagccagtagtggccgtcaccactcaagagccaaagagccactggatgcttgtctgcacgcatatacccgttgctgaccttatttacctccccttaacctctcctacctcagggctacatccagtggcagcacaggaaggatgtaccaacatctcctccaccgagacgtacgattacatcgttgtgggatccggtgctggcggtatccctgttgcggatcgcctgagcgaagctggccacaaggttctcctgatcgagaagggtccgccgtcgacggggagatggggtggaataatgaaaccggagtggctaatcggtacgaacctgacccgcttcgacgtcccgggtctctgcaaccagatctgggccgacccaaccggggccatctgcaccgacgtcgaccagatggcggggtgtatgctaggaggagggacagcggtcaacgccggactgtggtggaagccgcaccctgccgactgggacgtcaacttccccgagggttggcacagcgaggacatggcggaggccacagaacgcgtgtttgagcggatccccggcaccatcaccccgtcgatggacggcaagcggtacctctcgcagggcttcgacatgctgggcggcagcctcgaagctgccggctgggagtacctcgtccccaacgagcacccggacaggaagaaccgcacatacgggcacagcaccttcatgtactcgggcggagagaggggcgggcccctggccacatacctcgtctcggcggttcagcgcgagggctttacgctgtggatgaacacgactgtgacgcgcatcatccgggaaggcggccatgctacgggcgtcgaggtgcagtgcagcaacagcgaggcaggtcaggccggcatcgtcccgctcacccccaagaccggccgggttattgtctccgcgggagcattcggctcggcgaagctgctcttccgaagtaggttcttggagtcttccgccttcctgccgggggtgggcagtgggcctcggagaggttggtgatcttgttggcaagaaaggctgacaggattcacgccaggcggtatcggaccgaaggaccaactcaatattgtcaagaactcaaccgatgggcctagcatgatttcggaggaccagtggatcgaattgccggttggctacaacctcaatgatcacgtcggggtgagtaattcctgacgtagactcctggcgcgagcgtgcgtgcgtgcatgtgggtgtgtgtgtctgtctgtcaccgggtgcaggacgtgggactcctgtgcgggtattatcgctgaccagctcgtactgatgctgatgtaaaatacgagaccgacattgaaatagcacacccggatgtcgtcttctacgactactatggggcttgggacgagcccatcgtcgaggataccgaaagatatgtgggtgagttgccccgaaacgcccgtccgatcgcggcggaaccagggtcgaagttggttatatgtgagggctgatgttgcgcagccaacaggaccggtcctctggcgcaagctgcaccaaatattggcccgatcgtaagctaggacctacctcttccgctggatgtttgccggcgttatgctcatcatatttggtccagttctgggagaccataaaggggagcgacggtgtctctcgtcacctgcaatggcaggcgagggtcgagggaaaactcaacagtgagtttcccaatggctgtagggtggtaaatggcagtactgacaggaacgaccgtagcctccatgacgatcacccagtatttgggcacaggctcccgatctcgaggccggatgactatcacgaggcggttgaatacggtagtctcgacccctccatacctccgagatgagtatgacagggaggccgtcatccagggcatcgccaacctgcgagagtcattgaaaggggtggccaacctgacatggattactccgccgtcgaacgtgacggtggaggatttcgtggactcggtaagcgaaacgacacaatcggttactatgaatatgattacgtccagccagagcttgtaattacttacgaaggaacttggtccagatcccggctactccggcgcgccgttgctccaaccactggataggtgagagagatatataattatcccctttccttccggcgatgagtcctgcatttctctcgtcgcagacacaaactgctgacaacttcgggtcacaggcacggccaagattggcctcgacgacgggcgggaggggggcacgtcggtggtggaccttaacactaaggtgtacgggactgacaatatctttgtcgtcgacgcatccatcttccccggccacatcacaggcaatccctcggcagccattgtgatcgcggccgagtatgcggcggccaagatacttgcgctaccggccccggaggatgcggcatcgtgatggtttgctgcttcagctctcaaataaa

SEQ ID NO: 152 - protein, 578 aa, Chrysosporium lucknowense
MQVASKLVAVTGGALALWLHPVAAQEGCTNISSTETYDYIVVGSGAGGIPVADRLSEAGHKVLLIEKGPPSTGRWGGIMKPEWLIGTNLTRFDVPGLCNQIWADPTGAICTDVDQMAGCMLGGGTAVNAGLWWKPHPADWDVNFPEGWHSEDMAEATERVFERIPGTITPSMDGKRYLSQGFDMLGGSLEAAGWEYLVPNEHPDRKNRTYGHSTFMYSGGERGGPLATYLVSAVQREGFTLWMNTTVTRIIREGGHATGVEVQCSNSEAGQAGIVPLTPKTGRVIVSAGAFGSAKLLFRSGIGPKDQLNIVKNSTDGPSMISEDQWIELPVGYNLNDHVGTDIEIAHPDVVFYDYYGAWDEPIVEDTERYVANRTGPLAQAAPNIGPIFWETIKGSDGVSRHLQWQARVEGKLNTSMTITQYLGTGSRSRGRMTITRRLNTVVSTPPYLRDEYDREAVIQGIANLRESLKGVANLTWITPPSNVTVEDFVDSIPATPARRCSNHWIGTAKIGLDDGREGGTSVVDLNTKVYGTDNIFVVDASIFPGHITGNPSAAIVIAAEYAAAKILALPAPEDAAS

SEQ ID NO: 153 - DNA, 1734 bp, Chrysosporium lucknowense
atgcaagttgcttcaaagttggtagccgtcactggcggtgccctggcgctctggctacatccagtggcagcacaggaaggatgtaccaacatctcctccaccgagacgtacgattacatcgttgtgggatccggtgctggcggtatccctgttgcggatcgcctgagcgaagctggccacaaggttctcctgatcgagaagggtccgccgtcgacggggagatggggtggaataatgaaaccggagtggctaatcggtacgaacctgacccgcttcgacgtcccgggtctctgcaaccagatctgggccgacccaaccggggccatctgcaccgacgtcgaccagatggcggggtgtatgctaggaggagggacagcggtcaacgccggactgtggtggaagccgcaccctgccgactgggacgtcaacttccccgagggttggcacagcgaggacatggcggaggccacagaacgcgtgtttgagcggatccccggcaccatcaccccgtcgatggacggcaagcggtacctctcgcagggcttcgacatgctgggcggcagcctcgaagctgccggctgggagtacctcgtccccaacgagcacccggacaggaagaaccgcacatacgggcacagcaccttcatgtactcgggcggagagaggggcgggcccctggccacatacctcgtctcggcggttcagcgcgagggctttacgctgtggatgaacacgactgtgacgcgcatcatccgggaaggcggccatgctacgggcgtcgaggtgcagtgcagcaacagcgaggcaggtcaggccggcatcgtcccgctcacccccaagaccggccgggttattgtctccgcgggagcattcggctcggcgaagctgctcttccgaagcggtatcggaccgaaggaccaactcaatattgtcaagaactcaaccgatgggcctagcatgatttcggaggaccagtggatcgaattgccggttggctacaacctcaatgatcacgtcgggaccgacattgaaatagcacacccggatgtcgtcttctacgactactatggggcttgggacgagcccatcgtcgaggataccgaaagatatgtggccaacaggaccggtcctctggcgcaagctgcaccaaatattggcccgatcttctgggagaccataaaggggagcgacggtgtctctcgtcacctgcaatggcaggcgagggtcgagggaaaactcaacacctccatgacgatcacccagtatttgggcacaggctcccgatctcgaggccggatgactatcacgaggcggttgaatacggtagtctcgacccctccatacctccgagatgagtatgacagggaggccgtcatccagggcatcgccaacctgcgagagtcattgaaaggggtggccaacctgacatggattactccgccgtcgaacgtgacggtggaggatttcgtggactcgatcccggctactccggcgcgccgttgctccaaccactggataggcacggccaagattggcctcgacgacgggcgggaggggggcacgtcggtggtggaccttaacactaaggtgtacgggactgacaatatctttgtcgtcgacgcatccatcttccccggccacatcacaggcaatccctcggcagccattgtgatcgcggccgagtatgcggcggccaagatacttgcgctaccggccccggaggatgcggcatcg

SEQ ID NO: 154 - DNA, 1467 bp, Chrysosporium lucknowense
  CDS (180)..(439)
  CDS (568)..(1141)
gtataaagccttcttccatccctcccctgttgacagggcaagagatctttcttgatcggccactcccttaggttgccaacagagtctccccgagctcgagtctgctccaagacaacagacagagagaccctgcccggcaacacacacacacacacacacacacacacaccccatacaccatggttgctctctcttctctcctcgtcgctgcctctgcggcggccgtggccgtggctgcgccgagcgaggccctccagaagcgccagacgctcacgagcagccagacgggcttccacgacggcttttactactccttctggaccgacggtgccggcaacgtccggtacacgaacgaggccggcggccggtacagtgtcacctggtccggcaacaacggcaactgggttggcggcaagggctggaacccgggggctgctcggtatgcttcttcgtttctttcttcctttttgtttttgttttaaacaacaacaaaaaaagtaaacgaaggaaaaagaaaaagaaaagaaaaaaaagaggaaagaataattggctgacggcatcccacagcaacatcagcttcacggggcagtataaccccaacggcaactcgtacctggccgtgtacgggtggacgcgcaacccgctgatcgagtactacatcgtcgagaacttcggcacgtacgacccgtcgacgggggcgcagcggctcggcagcatcacggtggacgggtcgacgtacaacatcctcaagacgacgcgggtcaaccagccgtccatcgagggcaccagcacctttgaccagttctggtccgtccggaccaacaagcgcagcagcggctccgtcaacgtcaaggctcacttcgacgcttgggcccaggccggcctccgcctgggcacccacgactaccagatcatggccaccgagggctacttctcgagcggctccgccaccatcaccgtcggcgagggcaccagcagcggcggcggcggcgacaatggcggcggcaacaacggcggcggcggcaacaccggcacctgcagcgccctgtacggccagtgcggtggccaggggtggacgggcccgacttgctgctcccagggaacctgccgcgtctccaaccagtggtactcgcagtgcttgtaaaccaacggggctcacaaaagtgagcaaggagcaaggagcaaggagcaaggagaagccgaagcgatccctgtctatgagcggccacgcggaatcacgccgccgagctcaggggttcgcgcgttcaggggtctcaggagctgtgggttcggtcccaggagacgggacaggacaggtgtggtcttcgttgtatatagtttggatcttatgcatccggctttttacggaatgcagtacaaagttcttctgaattcaaccctccgggtctgacatggttcgctctcgaggatcgatcggttaatcacactgacttaaacccgggtata

SEQ ID NO: 155 - protein, 278 aa, Chrysosporium lucknowense
MVALSSLLVAASAAAVAVAAPSEALQKRQTLTSSQTGFHDGFYYSFWTDGAGNVRYTNEAGGRYSVTWSGNNGNWVGGKGWNPGAARNISFTGQYNPNGNSYLAVYGWTRNPLIEYYIVENFGTYDPSTGAQRLGSITVDGSTYNILKTTRVNQPSIEGTSTFDQFWSVRTNKRSSGSVNVKAHFDAWAQAGLRLGTHDYQIMATEGYFSSGSATITVGEGTSSGGGGDNGGGNNGGGGNTGTCSALYGQCGGQGWTGPTCCSQGTCRVSNQWYSQCL

SEQ ID NO: 156 - DNA, 834 bp, Chrysosporium lucknowense
atggttgctctctcttctctcctcgtcgctgcctctgcggcggccgtggccgtggctgcgccgagcgaggccctccagaagcgccagacgctcacgagcagccagacgggcttccacgacggcttttactactccttctggaccgacggtgccggcaacgtccggtacacgaacgaggccggcggccggtacagtgtcacctggtccggcaacaacggcaactgggttggcggcaagggctggaacccgggggctgctcgcaacatcagcttcacggggcagtataaccccaacggcaactcgtacctggccgtgtacgggtggacgcgcaacccgctgatcgagtactacatcgtcgagaacttcggcacgtacgacccgtcgacgggggcgcagcggctcggcagcatcacggtggacgggtcgacgtacaacatcctcaagacgacgcgggtcaaccagccgtccatcgagggcaccagcacctttgaccagttctggtccgtccggaccaacaagcgcagcagcggctccgtcaacgtcaaggctcacttcgacgcttgggcccaggccggcctccgcctgggcacccacgactaccagatcatggccaccgagggctacttctcgagcggctccgccaccatcaccgtcggcgagggcaccagcagcggcggcggcggcgacaatggcggcggcaacaacggcggcggcggcaacaccggcacctgcagcgccctgtacggccagtgcggtggccaggggtggacgggcccgacttgctgctcccagggaacctgccgcgtctccaaccagtggtactcgcagtgcttg

SEQ ID NO: 157 - DNA, 1099 bp, Chrysosporium lucknowense
  CDS (174)..(448)
  CDS (658)..(1072)
gtataaagaggcccatagacgcgcgactggtttcgatctcagaccctctctgttcatcagccacttccaacaagcagcatccacaggacgaggacgcggacttgtacttggatcccaccaggaagaccaacaacaacaacaacaacaacaaaaaaatcatcttcgtcgcaaacatggtctccttcaaggccctcgttctcggcgccgttggcgccctctccttccctttcaacgtcaccgagctgtccgaggcgcacgcccggggcgagaatgtgaccgagctcttgatgtctcgcgccggcacgccgagccagaccggctggcacgggggctactacttctccttctggaccgacaacggcggcaccgtcaactactggaacggcgacaatggcagatacggtgtccagtggcagaactgcggcaactttgtcggcggtaagggatggtaagtagagcaaatgtctcctccgcttctccaaccggtcccccccggtccccccccttttttttttccccctctccttctggttttgtttcttcttccaagctccccttcagagatttgggagagcgaggggaagacaggtaagatgaggagaagagaaaacaggacaaggcggctgacgcgggttggcgtggtacgataatgaacaggaaccccggcgcggcgcggaccatcaacttcagcggctccttcaacccgtcgggcaacgggtacctggccgtgtacgggtggacgcagaacccgctgatcgagtactacatcgtcgagtcgttcggcacgtacgacccgtcgtcgcaggcccaggtcctcggcaccttctaccaggacggcagcaactacaagatcgccaagacgacccgctacaaccagccctccatcgagggcaccagcaccttcgaccagttctggtccgtccgcgagaaccaccgcaccagcggcagcgtcaacgtcggcgcccacttcgcccgctggcagcaggccggcctccgcctcggcacccacaactaccaaatcatggccaccgagggctaccagagcagcggctcctccgatatcaccgtctggtaaagaagaaggggaagaagaagaaga

SEQ ID NO: 158 - protein, 230 aa, Chrysosporium lucknowense
MVSFKALVLGAVGALSFPFNVTELSEAHARGENVTELLMSRAGTPSQTGWHGGYYFSFWTDNGGTVNYWNGDNGRYGVQWQNCGNFVGGKGWNPGAARTINFSGSFNPSGNGYLAVYGWTQNPLIEYYIVESFGTYDPSSQAQVLGTFYQDGSNYKIAKTTRYNQPSIEGTSTFDQFWSVRENHRTSGSVNVGAHFARWQQAGLRLGTHNYQIMATEGYQSSGSSDITVW

SEQ ID NO: 159 - DNA, 690 bp, Chrysosporium lucknowense
atggtctccttcaaggccctcgttctcggcgccgttggcgccctctccttccctttcaacgtcaccgagctgtccgaggcgcacgcccggggcgagaatgtgaccgagctcttgatgtctcgcgccggcacgccgagccagaccggctggcacgggggctactacttctccttctggaccgacaacggcggcaccgtcaactactggaacggcgacaatggcagatacggtgtccagtggcagaactgcggcaactttgtcggcggtaagggatggaaccccggcgcggcgcggaccatcaacttcagcggctccttcaacccgtcgggcaacgggtacctggccgtgtacgggtggacgcagaacccgctgatcgagtactacatcgtcgagtcgttcggcacgtacgacccgtcgtcgcaggcccaggtcctcggcaccttctaccaggacggcagcaactacaagatcgccaagacgacccgctacaaccagccctccatcgagggcaccagcaccttcgaccagttctggtccgtccgcgagaaccaccgcaccagcggcagcgtcaacgtcggcgcccacttcgcccgctggcagcaggccggcctccgcctcggcacccacaactaccaaatcatggccaccgagggctaccagagcagcggctcctccgatatcaccgtctgg

SEQ ID NO: 160 - DNA, 2679 bp, Chrysosporium lucknowense
  CDS (54)..(458)
  CDS (518)..(603)
  CDS (681)..(936)
  CDS (1102)..(1674)
  CDS (1752)..(1777)
  CDS (2248)..(2288)
  CDS (2427)..(2440)
  CDS (2559)..(2564)
aggatgttggtaagccaactctgttccaggccatcccttgttagttagccatcatgaagtcccttgctctcttcctatcggctgccgcctcgctggtttcggcgtccgccatcgccctcgatcgtgaagctattccagccggggcgtcgataacatttccccgtcatgaatctcagttcaacccatccgtgacacttgaaggcaggggccacggcaggggtcacggcagggagaaggacaactggggcaacgctgtcgaaaaggaccgccagaaggtcactatccgcgcgtccaagcacgaccgcgatgatatcagtgacgacttcctctgggcactcaagaaggcgaaccatggcggcctactgcatctgcagaaggggaagaaatatgtaattggcaagaagctggatctgagttttctgaacgatatctatgtcaagatcgacggtgagctaaaggtattattgtttccacaccacggttgctgcacaggagtaagattgctgacccgcttcagttcaccaacgacattgaatactggcaggccaacaacttctactatgacttccagaagagcattaccttctgggtctggggtggcaagtacgcataatcataatcatccctttcttcgaatgttcgaatcacttctgggggagtccgctgctcacaccgcccagggatatcaagatatacggctccggcgtcatcaacggcaacggccaggcatggtgggacggcttctcgggccacgagattctcgaccccgacaatgagtactaccggcccattctgtttctgaccgacaacgccaccaacgtcgaggttcgcggcctgcacctcaaggactcgccgtgctggaccaacttctttgtgcgttccaagaacattgttttcgacgacgtctacatctctgccgtgtctaccaacgcatcggtaagaattttttattttttcttttatataattaatcatccgtccttcaattcatccctcccccttcatacaccccaagcatgcagatacagtgtgggtaattaattagggaagaaatttactgacgcccatcccttcttcccctaacatcaataattaccacagaccctgcccaagaacacggacggtttcgactcgctcaacgtctcgggcctgaccgtgctcaacacgcgcgtcaacgtgggcgacgactgcttctcgcccaagcccaacacgtccgacatcctggtgcgcaacctgtggtgcaacgggacgcacggggtgagcatgggcagcatcgggcagtacgcgggcgtgctggactacatcgcggacgcgcacatcgagaacgtgacgctgctcaacggcgagaacggggcgcggctcaaggcctgggccggcccggacgtcgggtacggctacatccgcaacgtcacctacaaggacatccgggtcgagaacaccgactcccccatcgtgctcgaccagtgctacttcaacgtcaacgagaccgtctgcgcgcagtatccgagcagggtcaacatcaccgacatcaacttcatcaacgtgcgcggcaccagcagcggtaaggaggggagggtcgtggcggacctcacctgctcccccggcgcgacctgtactggcatccatctggaggggatcgacatcaccagccccaagggctcgcccccgcagattgtgtgtgagaacatcgagggagatatcggcgttgactgtatccccaaggacgaggcggactattcaggttgagaaaggggagagggtacaggcaccaggacaggtatgtcatacagcggagcatctttgccgaacgcagtgatgagcttccgggagcgttgaaagcagtctgcagtaggtggctgtacgaaggaaaagagtgccttgttaaagctatctacaaaggagacaaaaggagtggtatttatagacaaagtgactggccaatgcgttaaacagccttatacagctatggcaaacgcgtagctaatacgtttagaagctctacagcttccgacataccccctagttgaacgcggtagtcgtttaactacgctttgtggtaatactgttcttagtgttatatcctttgtcactgttacctcgatagctcctttagaggcctgccttctatatttggaagtctaaaagagtcgagtatagtagagcgattcctttaaagctatagattaaatatagctattatagctatagtagtgataatattattagttttaattataataataataggataatgcctcttatgcttaaattaatggataacttgttaggtatgcctattataaacattataactactaataggttaactcttactcctataatgccttgaaagtataagtgtactaaagcttctatactataagtgttctagtcatattaagattgtttaagctaattaaaaatagtaacattaaagctagtaagctttataaggtgctttatagaatatacgtatagtcggctctaataggatattcttttagcaaatgttataatcattctagcactagctcttactactactattatacctatagttcctataagtataaggatatatatactaatcgcctatatatctaatagctcttataatacttatactaactataatagtagtcctacttcttatattaggttagcaaaggatttaataaa

SEQ ID NO: 161 - protein, 469 aa, Chrysosporium lucknowense
MKSLALFLSAAASLVSASAIALDREAIPAGASITFPRHESQFNPSVTLEGRGHGRGHGREKDNWGNAVEKDRQKVTIRASKHDRDDISDDFLWALKKANHGGLLHLQKGKKYVIGKKLDLSFLNDIYVKIDGELKFTNDIEYWQANNFYYDFQKSITFWVWGGKDIKIYGSGVINGNGQAWWDGFSGHEILDPDNEYYRPILFLTDNATNVEVRGLHLKDSPCWTNFFVRSKNIVFDDVYISAVSTNASTLPKNTDGFDSLNVSGLTVLNTRVNVGDDCFSPKPNTSDILVRNLWCNGTHGVSMGSIGQYAGVLDYIADAHIENVTLLNGENGARLKAWAGPDVGYGYIRNVTYKDIRVENTDSPIVLDQCYFNVNETVCAQYPSRVNITDINFINVRGTSSGKEGRVVADLTCSPGATCTGIHLEGIDITSPKGSPPQIGRGYRHQDRIMPLMLKLMDNLLVTLKLFL

SEQ ID NO: 162 - DNA, 1407 bp, Chrysosporium lucknowense
atgaagtcccttgctctcttcctatcggctgccgcctcgctggtttcggcgtccgccatcgccctcgatcgtgaagctattccagccggggcgtcgataacatttccccgtcatgaatctcagttcaacccatccgtgacacttgaaggcaggggccacggcaggggtcacggcagggagaaggacaactggggcaacgctgtcgaaaaggaccgccagaaggtcactatccgcgcgtccaagcacgaccgcgatgatatcagtgacgacttcctctgggcactcaagaaggcgaaccatggcggcctactgcatctgcagaaggggaagaaatatgtaattggcaagaagctggatctgagttttctgaacgatatctatgtcaagatcgacggtgagctaaagttcaccaacgacattgaatactggcaggccaacaacttctactatgacttccagaagagcattaccttctgggtctggggtggcaaggatatcaagatatacggctccggcgtcatcaacggcaacggccaggcatggtgggacggcttctcgggccacgagattctcgaccccgacaatgagtactaccggcccattctgtttctgaccgacaacgccaccaacgtcgaggttcgcggcctgcacctcaaggactcgccgtgctggaccaacttctttgtgcgttccaagaacattgttttcgacgacgtctacatctctgccgtgtctaccaacgcatcgaccctgcccaagaacacggacggtttcgactcgctcaacgtctcgggcctgaccgtgctcaacacgcgcgtcaacgtgggcgacgactgcttctcgcccaagcccaacacgtccgacatcctggtgcgcaacctgtggtgcaacgggacgcacggggtgagcatgggcagcatcgggcagtacgcgggcgtgctggactacatcgcggacgcgcacatcgagaacgtgacgctgctcaacggcgagaacggggcgcggctcaaggcctgggccggcccggacgtcgggtacggctacatccgcaacgtcacctacaaggacatccgggtcgagaacaccgactcccccatcgtgctcgaccagtgctacttcaacgtcaacgagaccgtctgcgcgcagtatccgagcagggtcaacatcaccgacatcaacttcatcaacgtgcgcggcaccagcagcggtaaggaggggagggtcgtggcggacctcacctgctcccccggcgcgacctgtactggcatccatctggaggggatcgacatcaccagccccaagggctcgcccccgcagattgggagagggtacaggcaccaggacaggataatgcctcttatgcttaaattaatggataacttgttagtaacattaaagctattccta

SEQ ID NO: 163 - DNA, 1950 bp, Chrysosporium lucknowense
  CDS (198)..(742)
  CDS (857)..(1031)
  CDS (1205)..(1478)
  CDS (1615)..(1889)
agatgcccgaccgtcctctccttctcgccgacttgccgctcgactactacatacaaagaagccagccatggcaggctaggggccatcaccgtactactctcacctaccttagctacccaccggcctaccgccaacacccccctcctcccttcttccccccttcttgaccctataagcaccgagcaaagcagcacaggatgcggttctcgacactgttcccggtgctcagcaccgtcgtcctcccgtcctcggccgccctcgtcaaggaaggctcaaggtgcgtcgtgagccccatctcggccgccgtcgcctcctccgaggagggcggactggtcgcgcgccagtcccaggtggacgacacgccgcagatcctcgaggccttctcgcagtgcggccaggatggcaccatcatcctgcaggagggcacctatcacatccggcaggtcatggacacgaccaacctgcgcaacgtgtccatcgagatctacggcacgctggtctggagcgccgacaacctcgactactggcggcgggccagcttcgacgtcgtctacgccggccgccagaccgcctggcgcatcggcgggcgcgacatcaccatgcgcggcttcggcaaggccctcttcgacggcaacggccaggcctggatcgacctggccaacggcgcgtccaacctgaacgggaggcccatctcgctgaccgtctggtacggcaccaacgtgttgatcgacggcatcacctggtagggtttcctcttttttttttttttttttttgttgttgttgttgttattgcccggcaacgcgacgggcatgccacaccgtccccgcgagtagctagctgacggggaggacaggcggatggcgcagttctggcacacttttgttgcccactcggagaacgtgaccatgaccaacttggacatgtacaccctctcttccaacggtaggagttcccagaacacggacgggacggatacctggaactccaagaatatcttcatcgcgaactggacggtgacctgtggtgatgtgagtttttttttgttttgttttgttttgttttgttttgtttcgtttttttggcgctgcttccaaaaaccccccttctttcctctcttttcccctcccccaacaaaaacacctcggaaatatcccaactcgtcggtcaggataccaaggcatgctgactcttctgcgaccaggactgcatcgctgtcaagggtaacagcaccaatgtccacgtcaagaacgtggcatgcaccgagtccggcgccaccgtcatcggcagcatcggctccaacgcgtggcagcccgactacgtcgagaacgtcgtgtttgagaacatcacggccaagcactcgagcaacgccgcctggatcaaaacgtaccctggaacgggatacgtccgcaacgtcaccttccgcaacatccacttcgaggacgtcaaccagcccatctacctatcctcgtgcatctgtacgtcttggcctcctcctttccctcccttcctatcgcctcctttctttcttccccaaacttgtaattgtaataataataataataataataataataacagaaaaaggggaaactaacaagatataatcaccagactcgtacaccaactgcgactcgtcccgcctcaggatcacggacgtcacctggcagaacatcacgggcacgagccggtacaacgtggcggcggccatgcactgcagcgcggccgccccctgcgacggcttccgcttcgagaacatcgacatcaagcccaagaacggcggctccgccaaggtgctgtgctccaacatccagaaccaggccaccatgggcctcacctgtaccgggccctgtccgggctcccagccgcagcagctgtcggggaacgtgtgataaccccctaactaagcgactcttttttcttggtgcgtcggatgaccacgggaagaaa

SEQ ID NO: 164 - protein, 423 aa, Chrysosporium lucknowense
MRFSTLFPVLSTVVLPSSAALVKEGSRCVVSPISAAVASSEEGGLVARQSQVDDTPQILEAFSQCGQDGTIILQEGTYHIRQVMDTTNLRNVSIEIYGTLVWSADNLDYWRRASFDVVYAGRQTAWRIGGRDITMRGFGKALFDGNGQAWIDLANGASNLNGRPISLTVWYGTNVLIDGITWRMAQFWHTFVAHSENVTMTNLDMYTLSSNGRSSQNTDGTDTWNSKNIFIANWTVTCGDDCIAVKGNSTNVHVKNVACTESGATVIGSIGSNAWQPDYVENVVFENITAKHSSNAAWIKTYPGTGYVRNVTFRNIHFEDVNQPIYLSSCIYSYTNCDSSRLRITDVTWQNITGTSRYNVAAAMHCSAAAPCDGFRFENIDIKPKNGGSAKVLCSNIQNQATMGLTCTGPCPGSQPQQLSGNV

SEQ ID NO: 165 - DNA, 1269 bp, Chrysosporium lucknowense
atgcggttctcgacactgttcccggtgctcagcaccgtcgtcctcccgtcctcggccgccctcgtcaaggaaggctcaaggtgcgtcgtgagccccatctcggccgccgtcgcctcctccgaggagggcggactggtcgcgcgccagtcccaggtggacgacacgccgcagatcctcgaggccttctcgcagtgcggccaggatggcaccatcatcctgcaggagggcacctatcacatccggcaggtcatggacacgaccaacctgcgcaacgtgtccatcgagatctacggcacgctggtctggagcgccgacaacctcgactactggcggcgggccagcttcgacgtcgtctacgccggccgccagaccgcctggcgcatcggcgggcgcgacatcaccatgcgcggcttcggcaaggccctcttcgacggcaacggccaggcctggatcgacctggccaacggcgcgtccaacctgaacgggaggcccatctcgctgaccgtctggtacggcaccaacgtgttgatcgacggcatcacctggcggatggcgcagttctggcacacttttgttgcccactcggagaacgtgaccatgaccaacttggacatgtacaccctctcttccaacggtaggagttcccagaacacggacgggacggatacctggaactccaagaatatcttcatcgcgaactggacggtgacctgtggtgatgactgcatcgctgtcaagggtaacagcaccaatgtccacgtcaagaacgtggcatgcaccgagtccggcgccaccgtcatcggcagcatcggctccaacgcgtggcagcccgactacgtcgagaacgtcgtgtttgagaacatcacggccaagcactcgagcaacgccgcctggatcaaaacgtaccctggaacgggatacgtccgcaacgtcaccttccgcaacatccacttcgaggacgtcaaccagcccatctacctatcctcgtgcatctactcgtacaccaactgcgactcgtcccgcctcaggatcacggacgtcacctggcagaacatcacgggcacgagccggtacaacgtggcggcggccatgcactgcagcgcggccgccccctgcgacggcttccgcttcgagaacatcgacatcaagcccaagaacggcggctccgccaaggtgctgtgctccaacatccagaaccaggccaccatgggcctcacctgtaccgggccctgtccgggctcccagccgcagcagctgtcggggaacgtg

SEQ ID NO: 166 - DNA, 2125 bp, Chrysosporium lucknowense
  CDS (60)..(257)
  CDS (316)..(377)
  CDS (449)..(515)
  CDS (579)..(636)
  CDS (716)..(957)
  CDS (1056)..(1396)
  CDS (1483)..(1540)
atgcggaaccgttggtgcagcaggaagcggtttactttctgtcgacaaccaactcaaccatgaagttcctcgacgtccttctcggtgccgcagctgccagctcggccctggcagcgccgacttgcacaaccaagacaaagcgcgcgggcaagttcaagtttgtcggcgtcaaccagtcctgcgccgagtttggccaggacacgctcccgggccagctcaacaagcactacacctggccggccaagtcgagcattgatgtaagtgtctttgaacttcgagctaccatgacgaaaaaggaacaatggaagtaaccaggctttcgaaaatcagacactcctcgccaccggaatgaacaccattcgcatcccgtttatgatgtaggactgagtgccctttccgcttcgctttacaagtaaagagggcacacattgctgacaacgggttgcagggagcgtcttatccccaaccaactgacgggaaccgtcaacgaaacgtactccgcggggcttatcgatgtatgaaacagacatagagcttctcaagaacggggggccggaatttgctgaccggaatttcagaccgtttcctacgtcacgagcaagggagcctatgctgtcattgacccccataacttcggtacgaccagcttacaatgaccatgtcttgggaccgtggcagacaagctaaccaagacttgctccaccaaatttcacaggccggtactacacgcaagtcatcaccgacgtcgaaggcttcaaggcctggtggacgaccacggccgggctgtttgccgacaacgacaaggtcatcttcgacaccaacaacgagtaccacgacatggaccaatcgctcgttgtcaatctgaaccaggccgccatcgacggcatccgggccgccggcgccacctcgcagtacatctttatcgagggcaactcgtggacgggcgcatggacctgggtacgaacacggatttctgatccggatatttatattgattttatgattttgtttttttggaccggtgtaatagcagctgacaatcatgtcatttccaggtctcctcgggcaacggcgagtccctgctgaacctgtcggacccggagggcgacgacaagctcatctacgagatgcaccagtacctggacgaggacgggtcgggcacgcacgagcagtgcgtctcgggcaccatcggccgggagcgcctccaggcggcgaccgagtggctcaaggccaacggcaagaaggccatcctgggcgagacggccggcggcgccaacgaccagtgcatctcggccctgaccggcatgctctccttcatggaggagaactcggacgtctggcagggctggctctggtgggctgccggtccctggtgggccgactacatgtactcgatgtgagtgttttcttatttttcttctctcatttcattcctttctgaagatcttgtttttttttccctccctgtctaacctcgcttagtgagccgccgagcggtaccgcgtacaccaaggttttgcccagcctccagccttatatctgagctcggtcggttctgcaaacgttgcggagcggaagaagattccactgttggggttgatcacaaagatactgagccttaagtgtactttacttcatcagggtagatgaaatcgagcaagatacatacagttccctgagagctatggtccttacgtcacgtcactcaactgaggacccaaattgcccgagtcttaatccaaagagtactccgtaccgctaccagggcgatgactcctgtaaattacactgataatacaaacctgtgaaacgttttctactctttacctcggagagactactggaggtatggtagaacgaggtgcgtccgtcgagctatgtgagaaagagggtgaattacgctgaagacctaacttgagcaagacttcaatggtcgccaattgcgggagcctaacaggcaccacggtaaactggcaggaggagacaaatgaacataataccttatccagtctgccctcgccgcgctcggaatatcccacctcatttgaactttcttcgccctctcagtgtcttttaattacgccgacttgattgaaacccgcgggaatacgcgaatgataataaa

SEQ ID NO: 167 - protein, 342 aa, Chrysosporium lucknowense
MKFLDVLLGAAAASSALAAPTCTTKTKRAGKFKFVGVNQSCAEFGQDTLPGQLNKHYTWPAKSSIDAFENQTLLATGMNTIRIPFMMERLIPNQLTGTVNETYSAGLIDTVSYVTSKGAYAVIDPHNFGRYYTQVITDVEGFKAWWTTTAGLFADNDKVIFDTNNEYHDMDQSLVVNLNQAAIDGIRAAGATSQYIFIEGNSWTGAWTWVSSGNGESLLNLSDPEGDDKLIYEMHQYLDEDGSGTHEQCVSGTIGRERLQAATEWLKANGKKAILGETAGGANDQCISALTGMLSFMEENSDVWQGWLWWAAGPWWADYMYSIEPPSGTAYTKVLPSLQPYI

SEQ ID NO: 168 - DNA, 1026 bp, Chrysosporium lucknowense
atgaagttcctcgacgtccttctcggtgccgcagctgccagctcggccctggcagcgccgacttgcacaaccaagacaaagcgcgcgggcaagttcaagtttgtcggcgtcaaccagtcctgcgccgagtttggccaggacacgctcccgggccagctcaacaagcactacacctggccggccaagtcgagcattgatgctttcgaaaatcagacactcctcgccaccggaatgaacaccattcgcatcccgtttatgatggagcgtcttatccccaaccaactgacgggaaccgtcaacgaaacgtactccgcggggcttatcgataccgtttcctacgtcacgagcaagggagcctatgctgtcattgacccccataacttcggccggtactacacgcaagtcatcaccgacgtcgaaggcttcaaggcctggtggacgaccacggccgggctgtttgccgacaacgacaaggtcatcttcgacaccaacaacgagtaccacgacatggaccaatcgctcgttgtcaatctgaaccaggccgccatcgacggcatccgggccgccggcgccacctcgcagtacatctttatcgagggcaactcgtggacgggcgcatggacctgggtctcctcgggcaacggcgagtccctgctgaacctgtcggacccggagggcgacgacaagctcatctacgagatgcaccagtacctggacgaggacgggtcgggcacgcacgagcagtgcgtctcgggcaccatcggccgggagcgcctccaggcggcgaccgagtggctcaaggccaacggcaagaaggccatcctgggcgagacggccggcggcgccaacgaccagtgcatctcggccctgaccggcatgctctccttcatggaggagaactcggacgtctggcagggctggctctggtgggctgccggtccctggtgggccgactacatgtactcgattgagccgccgagcggtaccgcgtacaccaaggttttgcccagcctccagccttatatc

SEQ ID NO: 169 - DNA, 1569 bp, Chrysosporium lucknowense
  CDS (285)..(1544)
accgcccacaacttcgcacccgatttagttggtttagcgagctctgggcccggccgtgacccgctacaaggatgttctggttaccgctgcgcagcagaccgatcgccctcccgacaacaagcgatgacccgccatcgccgctgcagctcccggcaccggtaccatcccgagaacaacggggaccgagtcgaacacgaagttgcagcctcctctcaccctcttccccctcttccccctctcgatttctccgccaccgccatcaccatcgccatcatcgccggccgatgctcgcgcttctcctgaccgtcgccgctctcggggccgccgccttattctttctgcagctctaccgtaccgagtcgcgtctgcgcaccccctggacgcccgaccggtcgtcgcgcctcttcgcccagcggccgctcccaccgccggtcgagggaacgttcctgtcatcaccgcactatacgttgccgctgcgcacgcgcgggcgcgatgtggtggatgcgcgggggcggcggttcaagctggcgagcgtcaactggtacggggcgagcgacgagctgatggtgccgggagggctggacgtgcggcaccggcgcgagatcgcgcgggccgtgcgccggctcggcttcaactcggtccgcctgccctactcggacgagatggtggcgactaacccgcccgtcgacgcccgcctggtggccgccaacccggacctggcgggcgcgcgggccctagacgtctacgtcgccgtcgtcgaggcgctgacggccgagggcgtcgccgtcgtggtcaacaaccacatcacgagcgcgacctggtgctgcggcgccgacccctgcgacgccggctgggccaacgaccacctgccggccgccctgtgccgcgtccgccagacggaggaccagtggatcgagcactgggagaccgtcatggccaggctggccgacaacccgctcgtcatcggcgccgacctgcgcaacgaggtccggggactctggggcaccatgccctgggcgcgctgggcggcggccgccgagagggccggcaaccggctgctccgcatgaacccggactggctcatcatcgtgggcggcaccgagtcgcagaacgacctgacgggcgtcgccacgcggcccgtcgtgctcgacctccccgaccgcgtcgtctactcggcccacgtctactcgtggagcggctggggcagctgggggggccggtacgcgacccggtcgtacccgagcttcgtccagtcggcgcgcaagaactgggcctacctggtcgagggggacgtggcgcccgtctgggtgggcgagttcggcgcgccccgctcgcccggccgcggcgacgccaactactggaacaacctgctccgctacctcaagaccatcgacgccgacttcggctactgggccctcaacccgcgcaagccccggcataacgagacggagacgtacgccctcctcgaggacgactgggtcaccccggtgctggactaccggctgaaggacctgaccgagctgatgcgagctggcaccaccacctgaagggaggaggagatggcaaaaa

SEQ ID NO: 170 - protein, 420 aa, Chrysosporium lucknowense
MLALLLTVAALGAAALFFLQLYRTESRLRTPWTPDRSSRLFAQRPLPPPVEGTFLSSPHYTLPLRTRGRDVVDARGRRFKLASVNWYGASDELMVPGGLDVRHRREIARAVRRLGFNSVRLPYSDEMVATNPPVDARLVAANPDLAGARALDVYVAVVEALTAEGVAVVVNNHITSATWCCGADPCDAGWANDHLPAALCRVRQTEDQWIEHWETVMARLADNPLVIGADLRNEVRGLWGTMPWARWAAAAERAGNRLLRMNPDWLIIVGGTESQNDLTGVATRPVVLDLPDRVVYSAHVYSWSGWGSWGGRYATRSYPSFVQSARKNWAYLVEGDVAPVWVGEFGAPRSPGRGDANYWNNLLRYLKTIDADFGYWALNPRKPRHNETETYALLEDDWVTPVLDYRLKDLTELMRAGTTT

SEQ ID NO: 171 - DNA, 1260 bp, Chrysosporium lucknowense
atgctcgcgcttctcctgaccgtcgccgctctcggggccgccgccttattctttctgcagctctaccgtaccgagtcgcgtctgcgcaccccctggacgcccgaccggtcgtcgcgcctcttcgcccagcggccgctcccaccgccggtcgagggaacgttcctgtcatcaccgcactatacgttgccgctgcgcacgcgcgggcgcgatgtggtggatgcgcgggggcggcggttcaagctggcgagcgtcaactggtacggggcgagcgacgagctgatggtgccgggagggctggacgtgcggcaccggcgcgagatcgcgcgggccgtgcgccggctcggcttcaactcggtccgcctgccctactcggacgagatggtggcgactaacccgcccgtcgacgcccgcctggtggccgccaacccggacctggcgggcgcgcgggccctagacgtctacgtcgccgtcgtcgaggcgctgacggccgagggcgtcgccgtcgtggtcaacaaccacatcacgagcgcgacctggtgctgcggcgccgacccctgcgacgccggctgggccaacgaccacctgccggccgccctgtgccgcgtccgccagacggaggaccagtggatcgagcactgggagaccgtcatggccaggctggccgacaacccgctcgtcatcggcgccgacctgcgcaacgaggtccggggactctggggcaccatgccctgggcgcgctgggcggcggccgccgagagggccggcaaccggctgctccgcatgaacccggactggctcatcatcgtgggcggcaccgagtcgcagaacgacctgacgggcgtcgccacgcggcccgtcgtgctcgacctccccgaccgcgtcgtctactcggcccacgtctactcgtggagcggctggggcagctgggggggccggtacgcgacccggtcgtacccgagcttcgtccagtcggcgcgcaagaactgggcctacctggtcgagggggacgtggcgcccgtctgggtgggcgagttcggcgcgccccgctcgcccggccgcggcgacgccaactactggaacaacctgctccgctacctcaagaccatcgacgccgacttcggctactgggccctcaacccgcgcaagccccggcataacgagacggagacgtacgccctcctcgaggacgactgggtcaccccggtgctggactaccggctgaaggacctgaccgagctgatgcgagctggcaccaccacc

SEQ ID NO: 172 - DNA, 1440 bp, Chrysosporium lucknowense
  CDS (131)..(932)
  CDS (1000)..(1089)
  CDS (1201)..(1418)
attaataataacagctgggggtgtctcggcacgctgcgcaaacattccatatgctcacctcttcgttgacggcttctgagggatcaaagcacgaaagactagaacggcattggaagtgttaattatagcgatgaaggccatcttcgccctcggcacctgcctgctttccgcggcccaatgccttccttcagcacgcgcgacggcctcgtccggcgccgaggggactcgcttctccatcgacggcaagacggggtacttcgcaggcaccaactcgtactggatcggcttcctgaccaacaacaaggaccttgacaccaccttggatcacatcgcctcctccggcctcaagatcctgcgtgtgtggggcttcaacgacgtcaacagcaggccgagtcccggcaccgtctggttccagctcctctcgtcctcgggttctgagatcaacatgggtcccgacggcctgcagcggctcgactatgtggtccagtcggcagagaagcgcggcgtcaagctgatcatcaacttcgtcaacaactgggatgactacggcggcatgaacgcctatgtcaaggcttttggcggcaccaaggagggctggtacaccaatgcccgggcccaagcgcagtacaagaagtacatacaggcggtggttagccgttacgacatgtccgacgccgtctttgcgtgggagttcgccaacgagccccggtgcaaggggtgcagcacggacgtcatctacaagtgggcgacggatatctcggcgtacatccgcagcctcgatccgagccacatgatcacgctgggcgacgagggtttcgggcttcccggagacggaacatacccctaccagtacagcgagggtgtggactttgtcaagaatttgaagatcaaggacttggatttcgggaccttccacatgtaccccgacagctgtgcgtttgcgttttgcctccgccgtacgtctgctcgtttttgtccatcactgactactgagcatagggggcgttccgtactccttcgccaacggctggatcaagagtcatgcggacgcgtgcaaagccgcgaacaagccatgtcttctggaagagtgtaagattgcgttctaataattcggcccatccgctcccgccgttcccaccctaattaattactccatttgaaagtgagttggaggaaaggttctctgacaatgactaccagacggcgcctacgctagctgcgatatccagaaaccctggcagcagacagctctttcgttcgctgccgacggtgtgagcggcgacctgttttggcggtggggcgaccagctcagttacggcctgtcgccaaacgacggcaacacggtctattacggttcatcacttgctcaatgcctcgtgacggatcatgttaaggctattaatggctcaggtgccgtttgattcaaaatctcttttgcaa

SEQ ID NO: 173 - protein, 370 aa, Chrysosporium lucknowense
MKAIFALGTCLLSAAQCLPSARATASSGAEGTRFSIDGKTGYFAGTNSYWIGFLTNNKDLDTTLDHIASSGLKILRVWGFNDVNSRPSPGTVWFQLLSSSGSEINMGPDGLQRLDYVVQSAEKRGVKLIINFVNNWDDYGGMNAYVKAFGGTKEGWYTNARAQAQYKKYIQAVVSRYDMSDAVFAWEFANEPRCKGCSTDVIYKWATDISAYIRSLDPSHMITLGDEGFGLPGDGTYPYQYSEGVDFVKNLKIKDLDFGTFHMYPDSWGVPYSFANGWIKSHADACKAANKPCLLEEYGAYASCDIQKPWQQTALSFAADGVSGDLFWRWGDQLSYGLSPNDGNTVYYGSSLAQCLVTDHVKAINGSGAV

SEQ ID NO: 174 - DNA, 1110 bp, Chrysosporium lucknowense
atgaaggccatcttcgccctcggcacctgcctgctttccgcggcccaatgccttccttcagcacgcgcgacggcctcgtccggcgccgaggggactcgcttctccatcgacggcaagacggggtacttcgcaggcaccaactcgtactggatcggcttcctgaccaacaacaaggaccttgacaccaccttggatcacatcgcctcctccggcctcaagatcctgcgtgtgtggggcttcaacgacgtcaacagcaggccgagtcccggcaccgtctggttccagctcctctcgtcctcgggttctgagatcaacatgggtcccgacggcctgcagcggctcgactatgtggtccagtcggcagagaagcgcggcgtcaagctgatcatcaacttcgtcaacaactgggatgactacggcggcatgaacgcctatgtcaaggcttttggcggcaccaaggagggctggtacaccaatgcccgggcccaagcgcagtacaagaagtacatacaggcggtggttagccgttacgacatgtccgacgccgtctttgcgtgggagttcgccaacgagccccggtgcaaggggtgcagcacggacgtcatctacaagtgggcgacggatatctcggcgtacatccgcagcctcgatccgagccacatgatcacgctgggcgacgagggtttcgggcttcccggagacggaacatacccctaccagtacagcgagggtgtggactttgtcaagaatttgaagatcaaggacttggatttcgggaccttccacatgtaccccgacagctggggcgttccgtactccttcgccaacggctggatcaagagtcatgcggacgcgtgcaaagccgcgaacaagccatgtcttctggaagagtacggcgcctacgctagctgcgatatccagaaaccctggcagcagacagctctttcgttcgctgccgacggtgtgagcggcgacctgttttggcggtggggcgaccagctcagttacggcctgtcgccaaacgacggcaacacggtctattacggttcatcacttgctcaatgcctcgtgacggatcatgttaaggctattaatggctcaggtgccgtt

SEQ ID NO: 175 - DNA, 1360 bp, Chrysosporium lucknowense
  CDS (1)..(171)
  CDS (233)..(562)
  CDS (629)..(1357)
atgcgctgtttaacttcaaggcttcttgccgccagtctgctgatccttagtactgccacggcggcccctggtcgttccaatttcgtgacggtcgagggagggatcttcaagctctcgggcaaggactttcactttgctgggagcaacgcttactactttcccttcaatggcgtaagtggttctcggttcatcttgatgatgccgtcgacttgctaacatgtcattcttttaggaccagcaagatattgaaaaggggctaacagccgccaagcgagccgggctctctgtcttccgcacctgggggtttaacgagaagaacagcacatacaaccccgatggtttgccccagtatggcggagaaggcgctggtcctaccgaagtcgtgtttcagaggtggtaccctaacggcacttccatcattgacatcagcggcttcgacaaagtggtcaaggctgcagaaaagactggaatcaagctccttgtcgctctgaccaacaactgggccgattatggcggcatggacgtctatactgtcaatctgggcggcagataccacgacgatgtgagcacgcccttgcttcgaccgcccgtgtaattactcctcacattgctaaccggacctcgtcagttctataccgtccccagaatcaaggaagccttcaagcgctatgtaaaggcggtcgtgactcggtacaaagattcgccgaccatctttgcttgggaactcgccaacgagccccgctgtggcgccgatggggtccgcaatcttccgcggagcgataactgcacgccccaggttctctcgtcttggatctcggagatgagcgcgtacatcaagagcctcgaccgcaaccatttggttacctggggaggcgagggaggcttcaaccgcgagtccgacgactgggcgtacaatggtgccgacggcggcgactttgaccatgagctctcgctcaagaccatcgactttggcgtcttccactcttatcctgactggtgggataagactgtcgagtggacgcaccagtggatccgtgatcatgctgccgccggtcggaaggctcgcaagcccgtcgtgcacgaagagtacggctggctgacgccggacaagaggctggagtacaccggcaaggtcgacaacaggacgagggtcgaggtactcggtggttggcaaaagacgactgtcagggaggagctggccgggagcatgtactggcagtacggatactcgaattattcctatggtcggaaccacgacgatggttttaccatctacttggacgacgaggaagccaagacgcttgtgtacgggcatgcgaaggaaatgaatgcccttaaccatcaccgtggtcggaagtag

SEQ ID NO: 176 - protein, 410 aa, Chrysosporium lucknowense
MRCLTSRLLAASLLILSTATAAPGRSNFVTVEGGIFKLSGKDFHFAGSNAYYFPFNGDQQDIEKGLTAAKRAGLSVFRTWGFNEKNSTYNPDGLPQYGGEGAGPTEVVFQRWYPNGTSIIDISGFDKVVKAAEKTGIKLLVALTNNWADYGGMDVYTVNLGGRYHDDFYTVPRIKEAFKRYVKAVVTRYKDSPTIFAWELANEPRCGADGVRNLPRSDNCTPQVLSSWISEMSAYIKSLDRNHLVTWGGEGGFNRESDDWAYNGADGGDFDHELSLKTIDFGVFHSYPDWWDKTVEWTHQWIRDHAAAGRKARKPVVHEEYGWLTPDKRLEYTGKVDNRTRVEVLGGWQKTTVREELAGSMYWQYGYSNYSYGRNHDDGFTIYLDDEEAKTLVYGHAKEMNALNHHRGRK

SEQ ID NO: 177 - DNA, 1230 bp, Chrysosporium lucknowense
atgcgctgtttaacttcaaggcttcttgccgccagtctgctgatccttagtactgccacggcggcccctggtcgttccaatttcgtgacggtcgagggagggatcttcaagctctcgggcaaggactttcactttgctgggagcaacgcttactactttcccttcaatggcgaccagcaagatattgaaaaggggctaacagccgccaagcgagccgggctctctgtcttccgcacctgggggtttaacgagaagaacagcacatacaaccccgatggtttgccccagtatggcggagaaggcgctggtcctaccgaagtcgtgtttcagaggtggtaccctaacggcacttccatcattgacatcagcggcttcgacaaagtggtcaaggctgcagaaaagactggaatcaagctccttgtcgctctgaccaacaactgggccgattatggcggcatggacgtctatactgtcaatctgggcggcagataccacgacgatttctataccgtccccagaatcaaggaagccttcaagcgctatgtaaaggcggtcgtgactcggtacaaagattcgccgaccatctttgcttgggaactcgccaacgagccccgctgtggcgccgatggggtccgcaatcttccgcggagcgataactgcacgccccaggttctctcgtcttggatctcggagatgagcgcgtacatcaagagcctcgaccgcaaccatttggttacctggggaggcgagggaggcttcaaccgcgagtccgacgactgggcgtacaatggtgccgacggcggcgactttgaccatgagctctcgctcaagaccatcgactttggcgtcttccactcttatcctgactggtgggataagactgtcgagtggacgcaccagtggatccgtgatcatgctgccgccggtcggaaggctcgcaagcccgtcgtgcacgaagagtacggctggctgacgccggacaagaggctggagtacaccggcaaggtcgacaacaggacgagggtcgaggtactcggtggttggcaaaagacgactgtcagggaggagctggccgggagcatgtactggcagtacggatactcgaattattcctatggtcggaaccacgacgatggttttaccatctacttggacgacgaggaagccaagacgcttgtgtacgggcatgcgaaggaaatgaatgcccttaaccatcaccgtggtcggaag

SEQ ID NO: 178 - DNA, 3366 bp, Chrysosporium lucknowense
  CDS (1760)..(1930)
  CDS (1998)..(2321)
  CDS (2388)..(3116)
gagagcatataaggctggctgttccctctgatggaattcaacttgtccaactcatcacatacatcctcttaccatcagcccaccgcaccttaccgcaccttgactctttggtggccccacgacgactcagcctagaacgcttacagcaacaatgaagtcgacgtacggagcagcgattcttgcgactgccacgctggttcaagggcatgggtacctgacgattccgtccagtcgaacacggcttggtgcagaggtaatattaattaatccataattagatcgctacgacccagattttaggagacagactaataacgcgggaagcaggccggcctcgattcttgtcccgagtgctcgattctcgagccggtgcagtcgtggcccgatctcgatgccgcgctggtcggacggagcggcccttgcggctacaatgcccgggttagcatcgactataaccagccgggtgagcactggggcaacgagccggtagcgacctactctcctggccaggttgtcgaggtgcagtggtgcgtcgatcacaatggagaccacggcggcatgttcagctaccgcatctgccagaaccagacgctggtcgacaagttcctcaccccgggttacctgcccaccgcagacgagaagcaggcggccgaagactgcttccaggctggcacgctctcgtgcaaagacgtgacgggacaggactgcgggtacaacccagactgctcggagggtcagccgtgctggcggaatgactggttcacctgcaacgcattccaggcagacagcaagcgcgcatgccagggagtcgacaacgcgcctcagggctcttgctacacgagcatctcgggcggcttcccggtcaccaagaagatcaagatccccgactaccagtcttctcacactctgctgtcattcaagtggaactcgttccagaccggtcagatctacctttcgtgcgccgacatcgccatcacagccagcaactagagccaaccgcccatacatgtcgacagccaggcttgccgctggcacacgaaattttacgatttgctcatcaaggagggaaagtaatggaacgagccaacgcgaacaatgaacaggttcccggtacctgggctggcagaatggttccaatgcgcaatgagtggataattaatatgggagttggatggctgttattagttttccacgacatttcgtcttgtgtcctgctccatgtcaatgtcccgaggtggcgtgactaaccctcctcgcgatactatcttcatttctttcgtccgagtagtcagaggacttgacacagctttggacatcctgatcttttgcgtgtgacccccctgttgccatcgagatttgcgtatgtatgtactatccggaaacggggcgcggcccatccacgtccgtgttcctatcggttccacagccgtgcaatggccgttggccgaaacaaagaatgatccccacaagctcgacctactactagtatgtacgcggtataaccgacattttgggcgcgcccaggccagagcgaagagggcgttgcggaagacggtgtcgctcgtccctgccaagcccttgccaagactttccttttctagagggcggctcaacggactccgatgccaaaaacgggaactaagaaggggaacaaacaaccaatgtttaaatctcaagatgacagacgacgttttgctcaacactcgtcctcctccagagtgtcacgcatactcctctttcagtattcttggtggtaacaatgcgctgtttaacttcaaggcttcttgccgccagtctgctgatccttagtactgccacggcggcccctggtcgttccaatttcgtgacggtcgagggagggatcttcaagctctcgggcaaggactttcactttgctgggagcaacgcttactactttcccttcaatggcgtaagtggttctcggttcatcttgatgatgccgtcgacttgctaacatgtcattcttttaggaccagcaagatattgaaaaggggctaacagccgccaagcgagccgggctctctgtcttccgcacctgggggtttaacgagaagaacagcacatacaaccccgatggtttgccccagtatggcggagaaggcgctggtcctaccgaagtcgtgtttcagaggtggtaccctaacggcacttccatcattgacatcagcggcttcgacaaagtggtcaaggctgcagaaaagactggaatcaagctccttgtcgctctgaccaacaactgggccgattatggcggcatggacgtctatactgtcaatctgggcggcagataccacgacgatgtgagcacgcccttgcttcgaccgcccgtgtaattactcctcacattgctaaccggacctcgtcagttctataccgtccccagaatcaaggaagccttcaagcgctatgtaaaggcggtcgtgactcggtacaaagattcgccgaccatctttgcttgggaactcgccaacgagccccgctgtggcgccgatggggtccgcaatcttccgcggagcgataactgcacgccccaggttctctcgtcttggatctcggagatgagcgcgtacatcaagagcctcgaccgcaaccatttggttacctggggaggcgagggaggcttcaaccgcgagtccgacgactgggcgtacaatggtgccgacggcggcgactttgaccatgagctctcgctcaagaccatcgactttggcgtcttccactcttatcctgactggtgggataagactgtcgagtggacgcaccagtggatccgtgatcatgctgccgccggtcggaaggctcgcaagcccgtcgtgcacgaagagtacggctggctgacgccggacaagaggctggagtacaccggcaaggtcgacaacaggacgagggtcgaggtactcggtggttggcaaaagacgactgtcagggaggagctggccgggagcatgtactggcagtacggatactcgaattattcctatggtcggaaccacgacgatggttttaccatctacttggacgacgaggaagccaagacgcttgtgtacgggcatgcgaaggaaatgaatgcccttaaccatcaccgtggtcggaagtagatgtggctttatagggtgtaaattagagcaggctggttggtggaggcctatcgttacaatgcacagaaccttcgtagtcaagaccaggatcgttcccgtgttttgattaattattaccaacttccgtgcgcctacgtggtctgcgccacgaccggtgtgtccctcccaagacaagaatcacaggtgcatggccaagccggcccgagcagcatctacaagtactttattagagttgcatctgaataac

SEQ ID NO: 179 - protein, 408 aa, Chrysosporium lucknowense
MRCLTSRLLAASLLILSTATAAPGRSNFVTVEGGIFKLSGKDFHFAGSNAYYFPFNGQDIEKGLTAAKRAGLSVFRTWGFNEKNSTYNPDGLPQYGGEGAGPTEVVFQRWYPNGTSIIDISGFDKVVKAAEKTGIKLLVALTNNWADYGGMDVYTVNLGGRYHDDFYTVPRIKEAFKRYVKAVVTRYKDSPTIFAWELANEPRCGADGVRNLPRSDNCTPQVLSSWISEMSAYIKSLDRNHLVTWGGEGGFNRESDDWAYNGADGGDFDHELSLKTIDFGVFHSYPDWWDKTVEWTHQWIRDHAAAGRKARKPVVHEEYGWLTPDKRLEYTGKVDNRTRVEVLGGWQKTTVREELAGSMYWQYGYSNYSYGRNHDDGFTIYLDDEEAKTLVYGHAKEMNALNHHRGRK

SEQ ID NO: 180 - DNA, 1224 bp, Chrysosporium lucknowense
atgcgctgtttaacttcaaggcttcttgccgccagtctgctgatccttagtactgccacggcggcccctggtcgttccaatttcgtgacggtcgagggagggatcttcaagctctcgggcaaggactttcactttgctgggagcaacgcttactactttcccttcaatggccaagatattgaaaaggggctaacagccgccaagcgagccgggctctctgtcttccgcacctgggggtttaacgagaagaacagcacatacaaccccgatggtttgccccagtatggcggagaaggcgctggtcctaccgaagtcgtgtttcagaggtggtaccctaacggcacttccatcattgacatcagcggcttcgacaaagtggtcaaggctgcagaaaagactggaatcaagctccttgtcgctctgaccaacaactgggccgattatggcggcatggacgtctatactgtcaatctgggcggcagataccacgacgatttctataccgtccccagaatcaaggaagccttcaagcgctatgtaaaggcggtcgtgactcggtacaaagattcgccgaccatctttgcttgggaactcgccaacgagccccgctgtggcgccgatggggtccgcaatcttccgcggagcgataactgcacgccccaggttctctcgtcttggatctcggagatgagcgcgtacatcaagagcctcgaccgcaaccatttggttacctggggaggcgagggaggcttcaaccgcgagtccgacgactgggcgtacaatggtgccgacggcggcgactttgaccatgagctctcgctcaagaccatcgactttggcgtcttccactcttatcctgactggtgggataagactgtcgagtggacgcaccagtggatccgtgatcatgctgccgccggtcggaaggctcgcaagcccgtcgtgcacgaagagtacggctggctgacgccggacaagaggctggagtacaccggcaaggtcgacaacaggacgagggtcgaggtactcggtggttggcaaaagacgactgtcagggaggagctggccgggagcatgtactggcagtacggatactcgaattattcctatggtcggaaccacgacgatggttttaccatctacttggacgacgaggaagccaagacgcttgtgtacgggcatgcgaaggaaatgaatgcccttaaccatcaccgtggtcggaag

SEQ ID NO: 181 - DNA, 2046 bp, Chrysosporium lucknowense
  CDS (108)..(300)
  CDS (345)..(1411)
  CDS (1537)..(1728)
  CDS (1825)..(1881)
gaatataagtcccggtctcgcggacgacaccagcgggacggcgcactcggcacgacaagctcacgggttccttggttaattatcccttagcgacaacgaaccctaccatggcgagaacgcttcgatacctgctgtgcggcatcctcgcgttagcggcgggcagcaatgcggttcccgcagcccgtggttcgacccgagcggccccggcggcagagcccagcactagtgcgacgacatacgaggccgaagatgccatcctgagcggaaccacggtcgataccgctcaggagggatataccggtgagtccggcatgaccggagagccctcctctgaccgtttaaaggagggaggaaaggagggaggaaaggacggacgacagatggtgaggagctgacggccgtggcaggatccggttacgtgaccggtttcgatgaggcgagcgacaagatcacgtttgaggtcgagagcgaggccactaagctctatgacctcagcatccgcatcgcggccatctacggcgacaaacacacgacggtggtgctgaacggcggggcgagcagcgacgtgtccttcccggccggcgacacgtgggtcgatgtcccggccggacaggtcctcctgaacgagggcgccaacacgatcgagattgtcagcaactgggggtggtacctcgtcgactccatcacgctcacgccctcggcgccgcggcccgagcaccagatcaaccggtccctcaacaacccgtcggccgacgcgagcgccagggccctgtacgactacctgcgctccatctacggcaagaagatcctcgcgggccagcaggacctgacctgggccgactacgtgacccagcagacgggcaagacgcccgcgctcgtgtcggtcgacctgatggactactcgccctcgcgggtcgagcgggggaccaagggcacgtcggtcgaggaggccatcacgcacgccgagcgcggcggcatcgtctcggccctctggcactggaacgcgcccgcgggcctgtacgacaccgacgagcacccctggtggagcggcttctacacggacgcgaccgacttcgacgtcgccgccgcgctgagctccaccgacaacgcaaactacaccctcctgctgcgcgacatcgacgccatcgccgtccagctcaagcgcctccgggacgcccgcgtgcccgtcctctggcggcccctccacgaggccgagggcggctggttctggtggggagccaagggcccggacccggccaagcagctctacgccctgctctacgaccgcctcgtcaaccaccacggcatcaacaacctcatctgggtctggaactcgctctcgcccgactggtatcccggcgacgacacggtcgacatcctgagcgcggacgtctacgctcaggggaacggcgtaagttcctatctaattattaattaattaccaacccaccaccacgactcagggtcattctgagagaagaggaaaagggggagggagaaaaaaaaaggtggctaacaaacttttcaaataattagccaatgtctacccagtacaaccagctcatcgacctcggcaaggataagaagatgatcgccgcggccgaggtgggcgccgcgccgcttccggatctgctgcaggcctacgaagcccattggttgtggttcgccgtctggggcgacacgttcataaacaacgccgagtggaactcgcccgaggtcctgaagacggtaggtttcaaccgatcccgagactgtacttttccttcccgggaagaaaaacaaaaaataaaaaaaaaaatctcgaaactgactcctcccgaccaggtctacaccagcgactacgtcctcaccctggacgagattcagggctggcaggattcgtgagggtattcagaacctaggaaggttgttcggctaggtaggtattaggagctgcaacagtggagttcgcccccgttgagacgagaatctggggccgtctggtgttaagcccgtcgggcagggtgtgcaggtaactttatctggtatagttcctactgccgtcaa

SEQ ID NO: 182 - protein, 503 aa, Chrysosporium lucknowense
MARTLRYLLCGILALAAGSNAVPAARGSTRAAPAAEPSTSATTYEAEDAILSGTTVDTAQEGYTGGRKGGRKGRTTDGEELTAVAGSGYVTGFDEASDKITFEVESEATKLYDLSIRIAAIYGDKHTTVVLNGGASSDVSFPAGDTWVDVPAGQVLLNEGANTIEIVSNWGWYLVDSITLTPSAPRPEHQINRSLNNPSADASARALYDYLRSIYGKKILAGQQDLTWADYVTQQTGKTPALVSVDLMDYSPSRVERGTKGTSVEEAITHAERGGIVSALWHWNAPAGLYDTDEHPWWSGFYTDATDFDVAAALSSTDNANYTLLLRDIDAIAVQLKRLRDARVPVLWRPLHEAEGGWFWWGAKGPDPAKQLYALLYDRLVNHHGINNLIWVWNSLSPDWYPGDDTVDILSADVYAQGNGPMSTQYNQLIDLGKDKKMIAAAEVGAAPLPDLLQAYEAHWLWFAVWGDTFINNAEWNSPEVLKTVYTSDYVLTLDEIQGWQDS

SEQ ID NO: 183 - DNA, 1509 bp, Chrysosporium lucknowense
atggcgagaacgcttcgatacctgctgtgcggcatcctcgcgttagcggcgggcagcaatgcggttcccgcagcccgtggttcgacccgagcggccccggcggcagagcccagcactagtgcgacgacatacgaggccgaagatgccatcctgagcggaaccacggtcgataccgctcaggagggatataccggagggaggaaaggagggaggaaaggacggacgacagatggtgaggagctgacggccgtggcaggatccggttacgtgaccggtttcgatgaggcgagcgacaagatcacgtttgaggtcgagagcgaggccactaagctctatgacctcagcatccgcatcgcggccatctacggcgacaaacacacgacggtggtgctgaacggcggggcgagcagcgacgtgtccttcccggccggcgacacgtgggtcgatgtcccggccggacaggtcctcctgaacgagggcgccaacacgatcgagattgtcagcaactgggggtggtacctcgtcgactccatcacgctcacgccctcggcgccgcggcccgagcaccagatcaaccggtccctcaacaacccgtcggccgacgcgagcgccagggccctgtacgactacctgcgctccatctacggcaagaagatcctcgcgggccagcaggacctgacctgggccgactacgtgacccagcagacgggcaagacgcccgcgctcgtgtcggtcgacctgatggactactcgccctcgcgggtcgagcgggggaccaagggcacgtcggtcgaggaggccatcacgcacgccgagcgcggcggcatcgtctcggccctctggcactggaacgcgcccgcgggcctgtacgacaccgacgagcacccctggtggagcggcttctacacggacgcgaccgacttcgacgtcgccgccgcgctgagctccaccgacaacgcaaactacaccctcctgctgcgcgacatcgacgccatcgccgtccagctcaagcgcctccgggacgcccgcgtgcccgtcctctggcggcccctccacgaggccgagggcggctggttctggtggggagccaagggcccggacccggccaagcagctctacgccctgctctacgaccgcctcgtcaaccaccacggcatcaacaacctcatctgggtctggaactcgctctcgcccgactggtatcccggcgacgacacggtcgacatcctgagcgcggacgtctacgctcaggggaacggcccaatgtctacccagtacaaccagctcatcgacctcggcaaggataagaagatgatcgccgcggccgaggtgggcgccgcgccgcttccggatctgctgcaggcctacgaagcccattggttgtggttcgccgtctggggcgacacgttcataaacaacgccgagtggaactcgcccgaggtcctgaagacggtctacaccagcgactacgtcctcaccctggacgagattcagggctggcaggattcg

SEQ ID NO: 184 - DNA, 2204 bp, Chrysosporium lucknowense
  CDS (161)..(267)
  CDS (357)..(551)
  CDS (647)..(774)
  CDS (857)..(945)
  CDS (1091)..(2107)
gaataaaaaacatcacagagtaattattgggtctttctgttgtccccccctcccccttttcccatcgagaagagagaaagggcaggagtgagaggcactatccccacgagatcagtattataggagggtaactctaagtttgcgttgttgtctgttcacaatggccacattcacaaggatcgaggacggcgaaagcccctccattaccatccatccctcgcacaagattgccaaaatcagcgacaacatctatggcggcttcacagagtaagaaagaaacaatgacaggactatggccccaacatggtctcgaaagacataatattacgaagtgctgacaaaccttggaaatccagacacatggggaggtgcatctacggtggcatctacgaccccggcaacccgctctcggacgagaacggcttccgcaaggacgtcatcgaggcccttaaggagctgagagtgcccgtggtccgatatcccggcggtaactttgttgccacgtacaactggctggacggcgttggcccgaaggagaagcggccaaagaggtgaaactctctctttctcactttgttattttctttctttctttctttctgtcttttttttttcattttcttgtcgaggactaaccagtgtacaggccagaattggcgtggatcggcgtcgagaccaacgagttcggaacagacgagttcatgaaatggtgtgaagtggtcggggccgagccgtacctctgcctcaacatgggcactggcaccctgtctgatggtcagtttaatgaatcaacccagtgtggggagtcgtcaatattccatcaactattaattaacacttaccaccactggaacagctctcgcctggctcgagtactgcaactcggaccgcgacacatactacgccaacctgcggcgtaagaacggccgtgagaagccatacaatgtattatgtgacggtgtccatttcctttttttttctttttcttttctttttttctttttgtttatttaatatttttttgcatccactttgtttttcaaccaacacggaccgctgaccgtctttcgcttccccctctcgtctgcaggtcaaatactgggcgctcgggaacgagtgctggggcccgtggcaggttgagcagatgaccaaggaggactacgcaaagaaggcgtaccagtgggccaaggcgctcaagttgctggacccgagcatcacgctgatcctgtgcggcgagacgggctactcgtcctgggaccaccacgtgctcaaggagtgcgtccgctgggacgtccacgggctcggggaccagaaccagaccaagtcgctcatcgacatgcacagcatccacgtctacacggccgaccgggagcacctccccaacgcgacggcgccccgcagcgccgagcgcgccatccagatggcctcggccctgatcgacctggcccggatcgagaacgaggtgccggcgacggttcccaagcaaaagatctgcttcgacgagtggaacgtctgggaccccgtccgcgcccccggcgagcagggggccgaggagcgctataccctctcggacgccctggccgtcgccgtctggctcaacgccttcgtccgccaggcccgcgacctcggcatggccaacatcgcccagtccgtcaacgtcatctcgcccctcatgaccacccgcgacggcctcgtcaagcagaccatctggtggcccctgctgctcttcagccgctacatgcgcggccacaccctcgccctccacgtccgcggccccgagtacaccggccggacccggccggcctggatccgcgccgccatcgagaccccttacctggactgcagcgccgccctgggcgacgacggcttcgtcaacctcgccgtcgccaacctgcacgagcagaacgactaccccgtcgacctcgacggcctccgcatcgcccacggcgaccgcgtcgccgtcttcctcgtcaccggcgaccacgtcggcgtcgccaacacggccgacgagcaaaaggtcggtatcgccgagagctcctgggacggcaagggcaagttcaccttcgtcaagcactccttcaccctgctgaggtggaagccggccgagtaattaaaacacgtcataatatcagaaaatcgagtccggggtttggagggaggagaaaggttagggaactggttaattattaggtcatcacgggtta

SEQ ID NO: 185 - protein, 512 aa, Chrysosporium lucknowense
MATFTRIEDGESPSITIHPSHKIAKISDNIYGGFTEHMGRCIYGGIYDPGNPLSDENGFRKDVIEALKELRVPVVRYPGGNFVATYNWLDGVGPKEKRPKRPELAWIGVETNEFGTDEFMKWCEVVGAEPYLCLNMGTGTLSDALAWLEYCNSDRDTYYANLRRKNGREKPYNVKYWALGNECWGPWQVEQMTKEDYAKKAYQWAKALKLLDPSITLILCGETGYSSWDHHVLKECVRWDVHGLGDQNQTKSLIDMHSIHVYTADREHLPNATAPRSAERAIQMASALIDLARIENEVPATVPKQKICFDEWNVWDPVRAPGEQGAEERYTLSDALAVAVWLNAFVRQARDLGMANIAQSVNVISPLMTTRDGLVKQTIWWPLLLFSRYMRGHTLALHVRGPEYTGRTRPAWIRAAIETPYLDCSAALGDDGFVNLAVANLHEQNDYPVDLDGLRIAHGDRVAVFLVTGDHVGVANTADEQKVGIAESSWDGKGKFTFVKHSFTLLRWKPAE

SEQ ID NO: 186 - DNA, 1536 bp, Chrysosporium lucknowense
atggccacattcacaaggatcgaggacggcgaaagcccctccattaccatccatccctcgcacaagattgccaaaatcagcgacaacatctatggcggcttcacagaacacatggggaggtgcatctacggtggcatctacgaccccggcaacccgctctcggacgagaacggcttccgcaaggacgtcatcgaggcccttaaggagctgagagtgcccgtggtccgatatcccggcggtaactttgttgccacgtacaactggctggacggcgttggcccgaaggagaagcggccaaagaggccagaattggcgtggatcggcgtcgagaccaacgagttcggaacagacgagttcatgaaatggtgtgaagtggtcggggccgagccgtacctctgcctcaacatgggcactggcaccctgtctgatgctctcgcctggctcgagtactgcaactcggaccgcgacacatactacgccaacctgcggcgtaagaacggccgtgagaagccatacaatgtcaaatactgggcgctcgggaacgagtgctggggcccgtggcaggttgagcagatgaccaaggaggactacgcaaagaaggcgtaccagtgggccaaggcgctcaagttgctggacccgagcatcacgctgatcctgtgcggcgagacgggctactcgtcctgggaccaccacgtgctcaaggagtgcgtccgctgggacgtccacgggctcggggaccagaaccagaccaagtcgctcatcgacatgcacagcatccacgtctacacggccgaccgggagcacctccccaacgcgacggcgccccgcagcgccgagcgcgccatccagatggcctcggccctgatcgacctggcccggatcgagaacgaggtgccggcgacggttcccaagcaaaagatctgcttcgacgagtggaacgtctgggaccccgtccgcgcccccggcgagcagggggccgaggagcgctataccctctcggacgccctggccgtcgccgtctggctcaacgccttcgtccgccaggcccgcgacctcggcatggccaacatcgcccagtccgtcaacgtcatctcgcccctcatgaccacccgcgacggcctcgtcaagcagaccatctggtggcccctgctgctcttcagccgctacatgcgcggccacaccctcgccctccacgtccgcggccccgagtacaccggccggacccggccggcctggatccgcgccgccatcgagaccccttacctggactgcagcgccgccctgggcgacgacggcttcgtcaacctcgccgtcgccaacctgcacgagcagaacgactaccccgtcgacctcgacggcctccgcatcgcccacggcgaccgcgtcgccgtcttcctcgtcaccggcgaccacgtcggcgtcgccaacacggccgacgagcaaaaggtcggtatcgccgagagctcctgggacggcaagggcaagttcaccttcgtcaagcactccttcaccctgctgaggtggaagccggccgag

SEQ ID NO: 187 - DNA, 1416 bp, Chrysosporium lucknowense
  CDS (135)..(327)
  CDS (413)..(1167)
agcgcgttctccccggaacagcaaacttgcgcgctattaattatttcaaccacccgttgctgattctctgcgtcactcacccttgggaactttaaccatccagtgaactcattgtacaagcgtcgcaaaacaaaatgtcaacacaattcccactctacacctccaagattgtcctcattcacctcatcacactgtctctcgccggagtgacaacggcacgcgacgctccgaaaaatctcctcgagttctacgatgtaatacgagcaaaagggcactgtcgccacgaactggcatcaggcttctacagccgcgacaatggccccaacagtaattacgcccattaattaattattattccatctcatgatcacaagcatcaaactaagcagtgtcctcgaacacacaacaacagactttgcctactgcggcgactacctcgacagcgcgggcgtaatctatatccaaggccgctccggcgccctggcgaacctggacgtagattgcgacggcagttcgggaggccccagcgacgacggccggtgccggcgcgagctcagcccggacctgcagaacgccacctcgttccgcgacgtgctcgccagctacggccgcgccggcgtcgccgaactcaacccgtacgtccacccttacgtcgtgttcggcaacgcgccggccacgaaaactaccaccgcatccacgggacggggggccaagtccggagcgtggcgagcgttcgacccgtccgagtacgggatgcggccgctcggcgtcatggcggtcgtctgcccgacgagccggaagctggtgtacggcgtgtggggggacatgaacggggacgacggggccaggccgatggtcggggaggcgtcgctggcgctggtgacggcctgcggcgggaagggggtcagcggggcggacgggatcgacgaggacgccgccctgttcctggggttcacgggcgacgaggcggtgccgggacgcgacggcgccgactgggccgccaaggactttgacacgtttgagaggagcatcgaacgattgggaaacaggctggtggagcgtgtccgggctgcagacgaggacgcgtcgtgcagcgtccggccaagctgggcccgggttgcggctgttgctgctgcggtggtgggctcgacatggttgcttctgtcataataggttgcgggcagcgcacatccgaggaggatgaaactaggtcgttattatgatgcattcatactgcgccaatctgttttggccggcattatgagatccagtgctgctataagtcggaccccccatataccgaccacccccattttccgaccgcttggcaaacctacaccgcttcctcaacccaaccacttcaacttaccacaactctaccaattccataccaaacaagctcatcttttgaatata

SEQ ID NO: 188 - protein, 316 aa, Chrysosporium lucknowense
MSTQFPLYTSKIVLIHLITLSLAGVTTARDAPKNLLEFYDVIRAKGHCRHELASGFYSRDNGPNNFAYCGDYLDSAGVIYIQGRSGALANLDVDCDGSSGGPSDDGRCRRELSPDLQNATSFRDVLASYGRAGVAELNPYVHPYVVFGNAPATKTTTASTGRGAKSGAWRAFDPSEYGMRPLGVMAVVCPTSRKLVYGVWGDMNGDDGARPMVGEASLALVTACGGKGVSGADGIDEDAALFLGFTGDEAVPGRDGADWAAKDFDTFERSIERLGNRLVERVRAADEDASCSVRPSWARVAAVAAAVVGSTWLLLS

SEQ ID NO: 189 - DNA, 948 bp, Chrysosporium lucknowense
atgtcaacacaattcccactctacacctccaagattgtcctcattcacctcatcacactgtctctcgccggagtgacaacggcacgcgacgctccgaaaaatctcctcgagttctacgatgtaatacgagcaaaagggcactgtcgccacgaactggcatcaggcttctacagccgcgacaatggccccaacaactttgcctactgcggcgactacctcgacagcgcgggcgtaatctatatccaaggccgctccggcgccctggcgaacctggacgtagattgcgacggcagttcgggaggccccagcgacgacggccggtgccggcgcgagctcagcccggacctgcagaacgccacctcgttccgcgacgtgctcgccagctacggccgcgccggcgtcgccgaactcaacccgtacgtccacccttacgtcgtgttcggcaacgcgccggccacgaaaactaccaccgcatccacgggacggggggccaagtccggagcgtggcgagcgttcgacccgtccgagtacgggatgcggccgctcggcgtcatggcggtcgtctgcccgacgagccggaagctggtgtacggcgtgtggggggacatgaacggggacgacggggccaggccgatggtcggggaggcgtcgctggcgctggtgacggcctgcggcgggaagggggtcagcggggcggacgggatcgacgaggacgccgccctgttcctggggttcacgggcgacgaggcggtgccgggacgcgacggcgccgactgggccgccaaggactttgacacgtttgagaggagcatcgaacgattgggaaacaggctggtggagcgtgtccgggctgcagacgaggacgcgtcgtgcagcgtccggccaagctgggcccgggttgcggctgttgctgctgcggtggtgggctcgacatggttgcttctgtca

SEQ ID NO: 190 - DNA, 2195 bp, Chrysosporium lucknowense
  CDS (894)..(2090)
gcataaaggcgcaccatatcataaagtggaaagagacagctacgctgcgacatcaagtatccattgtgagaggagaagcttggtatttgcgttgattttgtctcagacaacagcagcttcgtagcctttacacacgcatgtcttttccatgtctcagccaattccgattagtagtacaacacactccttggtgaatcgggttggggtagaagaatacgcagtctgcaacttcgagtagacagtgtcggctgacccgaacaatacgagtctggcagctgcattgcatcattccacagaatgggaagaagaccacatgacagtgcgctgttcgacggcggcgtcccggcgtccgaaaccatcatacaaagtaatttgctgtgcacaccaccgctgaattctttttacgcagcaactctacggtatctccaccagctcgggccgacggtgtttacttttatgtcctttcagggccccgttttcaggccgctcggagagaaaccgcagcccgcgtgaagagactcgtcatctgttcctacctcgggcggcacgctgaaagcatcaattaggccatgtgggaacatcccgtatccctctgagattcccatagggtcgtcactgccacctgcaggtatcacgaacatgctgtcggacggcataagcaaagagtctgtagcctcctcctcaaatggaacgccggaataccgaggcgttgaaagagagaatatcaacgcggtcactaatgcagttataaacacaacatcctctagagctcgtccatctctttttatgttcctttgcctcgctgtcatcttcgagagcaagtatatacacggtgaccctccagcccctcggtccctgactccgtttacgaacaacgacaatactagcacataatggtggccatacgatggggcagcctcgtagttcgggctacttgtttcacatcatcacttagaggcccatgccgcgagaaagcaattgcagccgagcactcactggaagcagccaaggcgctccaaggctggtacgatgccccgtcggggctgtggagcacaacgggctggtggaacagcgcaaactgccttactgtcctcgccgactgggcgctgagcgccggagccgccgctaaaagcttggatgtccctaaaatcatcgccaacacgttcaataacgcccagcgagtgtctgtgacagcgcagaagagggtagctgcgactggcttggccacatccacctaccattttgaccaccaggcaaagcggggattctcccagttcatcaacaactactacgatgatgagggctggtgggcgctcgccctgatcaggtcgtgggacgtaacccacgaccaggcctacctcgacatggccgagcgcatctttgaggacatgcaagctggcacggacgataggtgtggcggcggtatttggtggagcaaggagaagcagtacaagaacgccatcgcaaatgagttgtacctcagcgtggctgccagcctcgccaaccgcatccccgacaagaaacagaggtacgagcaactcgccaaggacgagtgggtgtggttcaaggacagcgggatgatcaacaagaacaacctcatcaacgacgggctcgccatcgacgtcaacggcagatgcaccaacaacggcctgaccacgtggtcgtacaatcagggcgtcgtgctgggcggcctggtcgagctcgccaacgccacgggcgacccgtcgtacctgggtgaggcgacggccatcgcgaaagcagctgtcgagcttctcagcgacgaaaatggcatcattcgcgaggcggaccggtgcgagcccgactgtggtgcagacggcagccagttcaagggcatcttcgtgcgcaacttgcattacctgcagcgagcggctccacaggatgcattccggacggcgatccagaagaatgccgactcaatctgggcgaataaccggaacggcaagaaccaattcggcatccagtgggccgggccggcagacgtgggtaacggaccgaacgctgcgacgcatagctcggcgatggacgtgatcgttgcggcgttggcgattggccggcagggtcggtttagataattaatgacttgagtagtggatgcgagcgagtagctgtttagaaaatcgagaaagaagcgttgtttaaaatccggatgcctcgcacattggaaaactaccgtg

SEQ ID NO: 191 - protein, 399 aa, Chrysosporium lucknowense
MVAIRWGSLVVRATCFTSSLRGPCREKAIAAEHSLEAAKALQGWYDAPSGLWSTTGWWNSANCLTVLADWALSAGAAAKSLDVPKIIANTFNNAQRVSVTAQKRVAATGLATSTYHFDHQAKRGFSQFINNYYDDEGWWALALIRSWDVTHDQAYLDMAERIFEDMQAGTDDRCGGGIWWSKEKQYKNAIANELYLSVAASLANRIPDKKQRYEQLAKDEWVWFKDSGMINKNNLINDGLAIDVNGRCTNNGLTTWSYNQGVVLGGLVELANATGDPSYLGEATAIAKAAVELLSDENGIIREADRCEPDCGADGSQFKGIFVRNLHYLQRAAPQDAFRTAIQKNADSIWANNRNGKNQFGIQWAGPADVGNGPNAATHSSAMDVIVAALAIGRQGRFR

SEQ ID NO: 192 - DNA, 1197 bp, Chrysosporium lucknowense
atggtggccatacgatggggcagcctcgtagttcgggctacttgtttcacatcatcacttagaggcccatgccgcgagaaagcaattgcagccgagcactcactggaagcagccaaggcgctccaaggctggtacgatgccccgtcggggctgtggagcacaacgggctggtggaacagcgcaaactgccttactgtcctcgccgactgggcgctgagcgccggagccgccgctaaaagcttggatgtccctaaaatcatcgccaacacgttcaataacgcccagcgagtgtctgtgacagcgcagaagagggtagctgcgactggcttggccacatccacctaccattttgaccaccaggcaaagcggggattctcccagttcatcaacaactactacgatgatgagggctggtgggcgctcgccctgatcaggtcgtgggacgtaacccacgaccaggcctacctcgacatggccgagcgcatctttgaggacatgcaagctggcacggacgataggtgtggcggcggtatttggtggagcaaggagaagcagtacaagaacgccatcgcaaatgagttgtacctcagcgtggctgccagcctcgccaaccgcatccccgacaagaaacagaggtacgagcaactcgccaaggacgagtgggtgtggttcaaggacagcgggatgatcaacaagaacaacctcatcaacgacgggctcgccatcgacgtcaacggcagatgcaccaacaacggcctgaccacgtggtcgtacaatcagggcgtcgtgctgggcggcctggtcgagctcgccaacgccacgggcgacccgtcgtacctgggtgaggcgacggccatcgcgaaagcagctgtcgagcttctcagcgacgaaaatggcatcattcgcgaggcggaccggtgcgagcccgactgtggtgcagacggcagccagttcaagggcatcttcgtgcgcaacttgcattacctgcagcgagcggctccacaggatgcattccggacggcgatccagaagaatgccgactcaatctgggcgaataaccggaacggcaagaaccaattcggcatccagtgggccgggccggcagacgtgggtaacggaccgaacgctgcgacgcatagctcggcgatggacgtgatcgttgcggcgttggcgattggccggcagggtcggtttaga

SEQ ID NO: 193 - DNA, 1869 bp, Chrysosporium lucknowense
  CDS (109)..(550)
  CDS (687)..(1079)
  CDS (1198)..(1613)
ctatgtaagatgggttgagacgctatacacttcaccgttcgcgatggcctctcatcatcactgctctgttcaagcaggagaggccttgaagcgaaagcacgcagtatcatgaagcctcgtttgttcctcacaatcttcggagggttcagtcaatcgtggctagcccaaggagttgcccgtcgcatcgatacccagcacgaagcagtcgaagcagcccctgagccctacagcgatgccgcggcgactggcccttcgccatccgagaccaggtacctgcagccgaggctagacttcgatatccgagcagcagcaaggtcggccatcgaggccatgaacaagaagttctattcctccgcgcaggcaatctggtcgccaggtgacccgtggtggctcagcggcgtagctctcaccgctgtcatagactacatgcgcaagacaggtaccggcgattacctgggtcaagttgagaacataatccgggtacagagaacccaacatccgcagaacggtggcgagttccgcgccgactcgactgacgatacgggatggtgtaagcaagaatctgtgcgctctgcgtcttggatgccgttctgggagtctccttgtgaccccgagaccgtgactctgcttcgagaatgccctggacacgcccagagaaggagccttttggctgacatcgttgacaggggggctcgccatgattcggatgtacgacctgacgggcaacagcacctacctcaacatcgcgaccgaggacgagacctttatgtacaaatactggacttccttcccttgcggtggtggaatatatgtcgacaccaaaaccaagacatacaagaacgccatcgcaaacgagctctacatcaagctcgcggcctccctgcacaaccgcatcgccaacgataccaagtacctttctcgagcggaaaccgcctggacctggttccaaagatcgggcatgatcaagggcgacaacctgatcaacgatggactagccgcttccagcaacggggcctgctacaacaataggctgcccgtctggacctacaaccaaggcgtcattctcggcgccctcgtcggtccgttctcgccactttccccccctttcctgttcgtctacgccccagcaatcacggcctgccttctgactaaaccattcgtattcctcccccccccccccccttccccgaatcacagaactctaccgtgccacctcctccgagagctacctgacctcggcccgcgccatcgccgacgcggtcctctccaacgacggcagcaccaatccgcagctcagctccccatacgacggcgaaggcggcgggggcgtcctgacggaggcgtcctgcaagcccgacgagccggacgggtgcaaccatgaccagcaggtcttcaagggcgtcctggcgtacaacctggccgagctcgacgcggccgtcccggacggcagccggccttaccgggcgtacctggagcggaacgcccagagcgcgtacgtcaacgcgcgggagcaggcgacagacctgtacgacgtcggctgggcagggccgcccttcaggaactcgacaatcgggaagcaggcgagcgcggtcgggctgctggtcgctgtggtctgacaggggaaagaccgggagaaaattggggggaagggagggaacaggggggtagtgcggtgctgtgagagataagggtagcaggtggtgtgattgcttgcgatttgcaatgttggataggcctgttcctccattcttgtccctgtctggtgatctcgttctagcttcgtatgcctggcaacgaggctagccgataagctttcaacctcacgagaaggttgacagaagcgtctctgtaaagaatagttgctgtgta

SEQ ID NO: 194 - protein, 417 aa, Chrysosporium lucknowense
MKPRLFLTIFGGFSQSWLAQGVARRIDTQHEAVEAAPEPYSDAAATGPSPSETRYLQPRLDFDIRAAARSAIEAMNKKFYSSAQAIWSPGDPWWLSGVALTAVIDYMRKTGTGDYLGQVENIIRVQRTQHPQNGGEFRADSTDDTGWWGLAMIRMYDLTGNSTYLNIATEDETFMYKYWTSFPCGGGIYVDTKTKTYKNAIANELYIKLAASLHNRIANDTKYLSRAETAWTWFQRSGMIKGDNLINDGLAASSNGACYNNRLPVWTYNQGVILGALVELYRATSSESYLTSARAIADAVLSNDGSTNPQLSSPYDGEGGGGVLTEASCKPDEPDGCNHDQQVFKGVLAYNLAELDAAVPDGSRPYRAYLERNAQSAYVNAREQATDLYDVGWAGPPFRNSTIGKQASAVGLLVAVV

SEQ ID NO: 195 - DNA, 1251 bp, Chrysosporium lucknowense
atgaagcctcgtttgttcctcacaatcttcggagggttcagtcaatcgtggctagcccaaggagttgcccgtcgcatcgatacccagcacgaagcagtcgaagcagcccctgagccctacagcgatgccgcggcgactggcccttcgccatccgagaccaggtacctgcagccgaggctagacttcgatatccgagcagcagcaaggtcggccatcgaggccatgaacaagaagttctattcctccgcgcaggcaatctggtcgccaggtgacccgtggtggctcagcggcgtagctctcaccgctgtcatagactacatgcgcaagacaggtaccggcgattacctgggtcaagttgagaacataatccgggtacagagaacccaacatccgcagaacggtggcgagttccgcgccgactcgactgacgatacgggatggtgggggctcgccatgattcggatgtacgacctgacgggcaacagcacctacctcaacatcgcgaccgaggacgagacctttatgtacaaatactggacttccttcccttgcggtggtggaatatatgtcgacaccaaaaccaagacatacaagaacgccatcgcaaacgagctctacatcaagctcgcggcctccctgcacaaccgcatcgccaacgataccaagtacctttctcgagcggaaaccgcctggacctggttccaaagatcgggcatgatcaagggcgacaacctgatcaacgatggactagccgcttccagcaacggggcctgctacaacaataggctgcccgtctggacctacaaccaaggcgtcattctcggcgccctcgtcgaactctaccgtgccacctcctccgagagctacctgacctcggcccgcgccatcgccgacgcggtcctctccaacgacggcagcaccaatccgcagctcagctccccatacgacggcgaaggcggcgggggcgtcctgacggaggcgtcctgcaagcccgacgagccggacgggtgcaaccatgaccagcaggtcttcaagggcgtcctggcgtacaacctggccgagctcgacgcggccgtcccggacggcagccggccttaccgggcgtacctggagcggaacgcccagagcgcgtacgtcaacgcgcgggagcaggcgacagacctgtacgacgtcggctgggcagggccgcccttcaggaactcgacaatcgggaagcaggcgagcgcggtcgggctgctggtcgctgtggtc

SEQ ID NO: 196 - DNA, 2460 bp, Chrysosporium lucknowense
  CDS (515)..(602)
  CDS (664)..(768)
  CDS (839)..(881)
  CDS (1087)..(2389)
ttattgattgaaaagccaccgtgccgtcattggatgcgcacatgcgtaatcacagaactaagcagccctctgcagcttcccccatacggccatgccatcaaatattacacgaaaggacttcgaatcaggccctgtctcctctctctgcaacttacggcgtttcatgcgccgaaaggtgcagtgaggagctgacgcccgaggactacgaggccaaattcaccaagaacagaccctcaagatgcccgtacgacagcgcacagtccttgaccgcggccagggctcctctggagccggtctgcgttgttaggtagctgagcgtcgaaccatcgctcattcattcatgtgacgcaggtgccctcggccatggtcaagtacggaagcaccgagactatttttctctcctcaccaagatgccaaaaagccactcgactgcctcgatcatcatccttcggccacaccaatgtctcccagtaccaggcttacggtttcccaatctctcgggcgctgggactctatgcattgcttgcgaggactgttgacgaagggtttgctggctactgcaccgctcagcgaagcctacacacttgacctaggctcgaaaggtgagaatgcgctcaatcgcagaagtaaagatgcagctctgacttgaacgtctgtgtgtagagtccctgaccacgatcgcgaggtccatggtagaggacatgatgtcattctacccggggaaccgccccggaggtgtccccggtctattaccaaaaccgtattattgtaggtttaattctagaacttcgacttaaccggcctgggcggctccgctaatcctctctacctggactagggtgggaagggggcactctgatgggctcgctgattgactactggtgcgtgcagcccaaaacagtgttctctcttacatgaaaacccccccggttctctttctctctctctttttttttctgtttctgttcttattttttgtttgggggggggggggggttgagggggcttagatatggctcggcgaggtgtttcgaccactcgtccctgacatgaaacgaagctgacatgatactataattacctaaggtactacacaggcgacacgcgatggaacggcgttgctcaagatggactgctcttccaaaccggaccaaacaacgattacatgccgccgaaccagaccatgaccgagggcaacgacgaccaggggttctggggcatggccgtcatgtcggccgcggagctcaacttcgatgatccgccgcacggcagaccgcaatggttggcgctcgcccaggccgtcttcaacactcaggccgctcgatgggaggaacgggattgcggaggcggcttgcggtggcagatcttcccctggaacaacgggtacgactataagaactccatctcccaggcctgcttcttcaacatcgccgcccgtctcgctctgtacactggcaaccagtcgtacgcggactgggccgaccgggtctgggattggatggcgaccacgaagctccttaacccggaaacataccacatctacgacggcgttcacgtcgagaactgctccaggattaccccttaccagtggacctacaacgccggcgcgatgctgctgggcgcggcggcgctctacaaccacagcgcgagcgccgcccggcgcgagacgtggcgcgagcgagtcgacggcctgctgaacggctccctcatcttcttcacgggcgagaacggcgacatcatgaccgaggtcgcgtgcgagcccgtagacctctgcgacctcgaccagcagagcttcaaggcgtacctctcgcgctggatggcggccaccatcaagtgggcgccctggacgaaccgccgcgtcaagcccctgctggcctcgtccgctgccgccgccgtggcaacctgcaccggcggcgacaacgggcgcatgtgcggtcttaaatggaacacgcgccggtgggacggcaccacaggggtcgggcagcagatggccgccatggaggtcgtcttggcaaacgcgatcgagcactcgcggccgcccgtgacggaccggaacggcggcacgagcgtcggcgacccgggggcgggcagcgcggacgtcggccgcaagacgccggaggagtactcctcggtctcgactgcggagaagaccggggcgtacatccttaccgtgctgttcgtgatcggcgtgatcgccgggagcctgtttgccttggatgacgagtacaaccgctcgtccgtgccggaacggcttgcgcggctccgcgcggtggtggtcagcggtgtccgcagctggagctgcagtgtcctttcgctcttttggcaacggggcggccgcggccaagcgaagggaaagtgggtaggccggtccgagagcaacgagcaacagtaagatggggcgggaaccggaaagggagagatggtcgtacactcgtgtgtctgtgtaacacgggtcggtca

SEQ ID NO: 197 - protein, 513 aa, Chrysosporium lucknowense
MHCLRGLLTKGLLATAPLSEAYTLDLGSKESLTTIARSMVEDMMSFYPGNRPGGVPGLLPKPYYWWEGGTLMGSLIDYWYYTGDTRWNGVAQDGLLFQTGPNNDYMPPNQTMTEGNDDQGFWGMAVMSAAELNFDDPPHGRPQWLALAQAVFNTQAARWEERDCGGGLRWQIFPWNNGYDYKNSISQACFFNIAARLALYTGNQSYADWADRVWDWMATTKLLNPETYHIYDGVHVENCSRITPYQWTYNAGAMLLGAAALYNHSASAARRETWRERVDGLLNGSLIFFTGENGDIMTEVACEPVDLCDLDQQSFKAYLSRWMAATIKWAPWTNRRVKPLLASSAAAAVATCTGGDNGRMCGLKWNTRRWDGTTGVGQQMAAMEVVLANAIEHSRPPVTDRNGGTSVGDPGAGSADVGRKTPEEYSSVSTAEKTGAYILTVLFVIGVIAGSLFALDDEYNRSSVPERLARLRAVVVSGVRSWSCSVLSLFWQRGGRGQAKGKWVGRSESNEQQ

SEQ ID NO: 198 - DNA, 1539 bp, Chrysosporium lucknowense
atgcattgcttgcgaggactgttgacgaagggtttgctggctactgcaccgctcagcgaagcctacacacttgacctaggctcgaaagagtccctgaccacgatcgcgaggtccatggtagaggacatgatgtcattctacccggggaaccgccccggaggtgtccccggtctattaccaaaaccgtattattggtgggaagggggcactctgatgggctcgctgattgactactggtactacacaggcgacacgcgatggaacggcgttgctcaagatggactgctcttccaaaccggaccaaacaacgattacatgccgccgaaccagaccatgaccgagggcaacgacgaccaggggttctggggcatggccgtcatgtcggccgcggagctcaacttcgatgatccgccgcacggcagaccgcaatggttggcgctcgcccaggccgtcttcaacactcaggccgctcgatgggaggaacgggattgcggaggcggcttgcggtggcagatcttcccctggaacaacgggtacgactataagaactccatctcccaggcctgcttcttcaacatcgccgcccgtctcgctctgtacactggcaaccagtcgtacgcggactgggccgaccgggtctgggattggatggcgaccacgaagctccttaacccggaaacataccacatctacgacggcgttcacgtcgagaactgctccaggattaccccttaccagtggacctacaacgccggcgcgatgctgctgggcgcggcggcgctctacaaccacagcgcgagcgccgcccggcgcgagacgtggcgcgagcgagtcgacggcctgctgaacggctccctcatcttcttcacgggcgagaacggcgacatcatgaccgaggtcgcgtgcgagcccgtagacctctgcgacctcgaccagcagagcttcaaggcgtacctctcgcgctggatggcggccaccatcaagtgggcgccctggacgaaccgccgcgtcaagcccctgctggcctcgtccgctgccgccgccgtggcaacctgcaccggcggcgacaacgggcgcatgtgcggtcttaaatggaacacgcgccggtgggacggcaccacaggggtcgggcagcagatggccgccatggaggtcgtcttggcaaacgcgatcgagcactcgcggccgcccgtgacggaccggaacggcggcacgagcgtcggcgacccgggggcgggcagcgcggacgtcggccgcaagacgccggaggagtactcctcggtctcgactgcggagaagaccggggcgtacatccttaccgtgctgttcgtgatcggcgtgatcgccgggagcctgtttgccttggatgacgagtacaaccgctcgtccgtgccggaacggcttgcgcggctccgcgcggtggtggtcagcggtgtccgcagctggagctgcagtgtcctttcgctcttttggcaacggggcggccgcggccaagcgaagggaaagtgggtaggccggtccgagagcaacgagcaacag

SEQ ID NO: 199 - DNA, 1718 bp, Chrysosporium lucknowense
  CDS (62)..(127)
  CDS (327)..(1589)
gtcgctctgagtcttttgctgtacctcctcactcgttgatttcgcaggcggaaccgggaatatgaggatatctgggatcttggcctcgctctgtgtgctggcccggtgcgggacggcaatcgacttggtacttggggatgagggtaaggagagctggtttcgatcttggagtgacaaaagcagcgcagcggctaatggatttccagactcggttaaatccgcagccagcacaatagcctttgggctggtcaaggtaagcaggatgcatcacgggtgctgagtgtacgatctctctctcgaacggttccgctgacatgtgtctccagtattacacgggcaataacacgggcgacactccgggaaacctgccggacccatacttctggtgggaagcgggcgccatgttcgggactctggtcgactactgggcgctcaccggagacgactcgtacaacgccatcaccacccaggcgatcctgcaccaagcgaccgagaagggcgacttcatgccgcccaaccagacgcgcacgctcggcaacgacgaccaggggttctggggcatggcagccatgtcagcggccgagaacaacttccccaacccgcccgaggaccagccgcagtggctggccctggcccagtccctcttcaaccagtacgcctcccgctgggaggaggccacgtgcggcggcgggctccgctggcagatcttcacctttaacaacggcttcaactacaagaactccatctccaacgggtgcttcttcaacatcgccgcccgcctggcccgctacacgggcaacgagacctacgccgagtgggccgaaaagatctttgcctgggaggagtcggtgggactcatcgacgccaacctgacggtgcgggacggcgtgcacgtcagcctcgaggacggcagctgcaacagcagggacgagaaccagtggacctacaacgcgggcatcttcctgcacggcgcggccgtcatgtacaaccacaccaacgcctcggccatctggcgggagcgcgtcgacggcctgctggcctccaccacggccaccttcgtcgacccggccacgggcgtgctggtcgagcagctgtgcgagcccagcggcttctgcaacacggaccagcgctccttcaagggctacatgacccgctggctggccgggaccgcgcagatggcgccgcacaccctcgacgccgtccgcccgctgctcgaggccgacgccgccgccgccgcccgtgcctgcaccggcgaccccgcgcctcccgtgttccgcggccacccgggcaccgcgtgcgggttccgctggaccaccggcgccttcgacggctccgccggcgtcggcgagcagatgaacgccctctcggccgtcatgtaccccctcgtcgtccggggagccgccgccccgcccctgaccgccgacacgggcggtacctcgaagggcaaccccggcggcggcgccgcgcccgcgcacgaggaggtcggcatcgggtgcgcggagatcacgctccaggaccgggtcgccgccgggttcgtcacatcggccctcgcgctcggcgtcgtcgccgggtccgcgtttgtcatcctctaaggtttggcattaggcaagccgcgttcctcccccttctggtggcttgtcaacgtgtggtttttttttctggtgttgatttcttggggacctatttttgaatatccgggtttcaatcggacaaaataa

SEQ ID NO: 200 - protein, 443 aa, Chrysosporium lucknowense
MRISGILASLCVLARCGTAIDLYYTGNNTGDTPGNLPDPYFWWEAGAMFGTLVDYWALTGDDSYNAITTQAILHQATEKGDFMPPNQTRTLGNDDQGFWGMAAMSAAENNFPNPPEDQPQWLALAQSLFNQYASRWEEATCGGGLRWQIFTFNNGFNYKNSISNGCFFNIAARLARYTGNETYAEWAEKIFAWEESVGLIDANLTVRDGVHVSLEDGSCNSRDENQWTYNAGIFLHGAAVMYNHTNASAIWRERVDGLLASTTATFVDPATGVLVEQLCEPSGFCNTDQRSFKGYMTRWLAGTAQMAPHTLDAVRPLLEADAAAAARACTGDPAPPVFRGHPGTACGFRWTTGAFDGSAGVGEQMNALSAVMYPLVVRGAAAPPLTADTGGTSKGNPGGGAAPAHEEVGIGCAEITLQDRVAAGFVTSALALGVVAGSAFVIL

SEQ ID NO: 201 - DNA, 1329 bp, Chrysosporium lucknowense
atgaggatatctgggatcttggcctcgctctgtgtgctggcccggtgcgggacggcaatcgacttgtattacacgggcaataacacgggcgacactccgggaaacctgccggacccatacttctggtgggaagcgggcgccatgttcgggactctggtcgactactgggcgctcaccggagacgactcgtacaacgccatcaccacccaggcgatcctgcaccaagcgaccgagaagggcgacttcatgccgcccaaccagacgcgcacgctcggcaacgacgaccaggggttctggggcatggcagccatgtcagcggccgagaacaacttccccaacccgcccgaggaccagccgcagtggctggccctggcccagtccctcttcaaccagtacgcctcccgctgggaggaggccacgtgcggcggcgggctccgctggcagatcttcacctttaacaacggcttcaactacaagaactccatctccaacgggtgcttcttcaacatcgccgcccgcctggcccgctacacgggcaacgagacctacgccgagtgggccgaaaagatctttgcctgggaggagtcggtgggactcatcgacgccaacctgacggtgcgggacggcgtgcacgtcagcctcgaggacggcagctgcaacagcagggacgagaaccagtggacctacaacgcgggcatcttcctgcacggcgcggccgtcatgtacaaccacaccaacgcctcggccatctggcgggagcgcgtcgacggcctgctggcctccaccacggccaccttcgtcgacccggccacgggcgtgctggtcgagcagctgtgcgagcccagcggcttctgcaacacggaccagcgctccttcaagggctacatgacccgctggctggccgggaccgcgcagatggcgccgcacaccctcgacgccgtccgcccgctgctcgaggccgacgccgccgccgccgcccgtgcctgcaccggcgaccccgcgcctcccgtgttccgcggccacccgggcaccgcgtgcgggttccgctggaccaccggcgccttcgacggctccgccggcgtcggcgagcagatgaacgccctctcggccgtcatgtaccccctcgtcgtccggggagccgccgccccgcccctgaccgccgacacgggcggtacctcgaagggcaaccccggcggcggcgccgcgcccgcgcacgaggaggtcggcatcgggtgcgcggagatcacgctccaggaccgggtcgccgccgggttcgtcacatcggccctcgcgctcggcgtcgtcgccgggtccgcgtttgtcatcctc

SEQ ID NO: 202 - DNA, 1527 bp, Chrysosporium lucknowense
  CDS (41)..(155)
  CDS (218)..(1524)
ggttcgccgcatcagagtgtcgtgaccgaagtttgggaggatggcactatcaccaccgttaaacagccctgcgcgatggctgctaagcgctcttcttgcgacgagcagcttgctcccggtcgcacagggccaggggtacaaggttggcacaccaggtatattctaagaggagcgacccaggggatcaagactgtcaggtaagctaatcgggccatagacgaaattcgggaatctgcacgaaccctcgcctacgacctgatgctgttctacaagggcaatcagtccggtgaaattccaggcatcttgccaggtccgccaacagagcacaagggcgactactactggtgggaaggaggggccatgatgggcacatacgtcgattactggttcctgaccggcgacccgagttacaaccacgtcgtcacagagggcatgctgcatcaggtcgggcccaacgccgactacatgccccctaaccacacggcttccctgggcaacgacgaccagggattctggggcatgtcggccatgctcgccgccgagaataagttccccaacccgcccgaggacaagccgcagtggctcgcgctcgcccaggccgtctttcacactcaagcagcgcccgaccgccacgacggaacgtgcaacggcggccttcgctggcaggtgcctccgaccaacgcgggatacaactataagaacaccatcgccaacgcctgcttcttcaacctgggcgcccgcctggcccgctacaccgagaaccagacgtacgccgactgggccagcaagacgttccagtggctctgggacgtaggctacatcgaccacgagagctggaaggtctacgacggcggtcatgtcgagcacaactgcaccgacatcaacaaggcccagttcagctacaacgccgccctgctccttcacgggtccgccttcatgtacaactacaccaacggcagcgagatctggagggagcgcgtcgacaagctgctcgagggcatcctccgcgacttcttccccgacggcgtcgccttcgagctgccctgcgagggccgcaagggcgcctgcaccgccgacatgctgtccttcaagggctacgtccaccgctggatggcggtggtgaccaagctggtgcccgacacggccgggaccatcctgcccgtgctgcggacctcggccgaggcggccgcgaggcagtgcacgggcggcgacacgggccgccgctgcggcttctactggtccgagggcgtcttcgtcgacccggccgtcgacaagaccagcggcgccggcgaggccatgagcgtgctcgccgccgtgtccagcttgctcatcgacgaggcgcccccgccggccaccaacgccaccggcatcagcaggggcgatcccaacgccggcagccgcagccgcggcccttcggagccgctcgcgcccatcaccactgccgatcgggccggcgcgggcatcctgaccatgttgatccttggcggtttcattggtacctggagctggatgagcatcggtgattaa

SEQ ID NO: 203 - protein, 474 aa, Chrysosporium lucknowense
MALSPPLNSPARWLLSALLATSSLLPVAQGQGYKVGTPDEIRESARTLAYDLMLFYKGNQSGEIPGILPGPPTEHKGDYYWWEGGAMMGTYVDYWFLTGDPSYNHVVTEGMLHQVGPNADYMPPNHTASLGNDDQGFWGMSAMLAAENKFPNPPEDKPQWLALAQAVFHTQAAPDRHDGTCNGGLRWQVPPTNAGYNYKNTIANACFFNLGARLARYTENQTYADWASKTFQWLWDVGYIDHESWKVYDGGHVEHNCTDINKAQFSYNAALLLHGSAFMYNYTNGSEIWRERVDKLLEGILRDFFPDGVAFELPCEGRKGACTADMLSFKGYVHRWMAVVTKLVPDTAGTILPVLRTSAEAAARQCTGGDTGRRCGFYWSEGVFVDPAVDKTSGAGEAMSVLAAVSSLLIDEAPPPATNATGISRGDPNAGSRSRGPSEPLAPITTADRAGAGILTMLILGGFIGTWSWMSIGD

SEQ ID NO: 204 - DNA, 1422 bp, Chrysosporium lucknowense
atggcactatcaccaccgttaaacagccctgcgcgatggctgctaagcgctcttcttgcgacgagcagcttgctcccggtcgcacagggccaggggtacaaggttggcacaccagacgaaattcgggaatctgcacgaaccctcgcctacgacctgatgctgttctacaagggcaatcagtccggtgaaattccaggcatcttgccaggtccgccaacagagcacaagggcgactactactggtgggaaggaggggccatgatgggcacatacgtcgattactggttcctgaccggcgacccgagttacaaccacgtcgtcacagagggcatgctgcatcaggtcgggcccaacgccgactacatgccccctaaccacacggcttccctgggcaacgacgaccagggattctggggcatgtcggccatgctcgccgccgagaataagttccccaacccgcccgaggacaagccgcagtggctcgcgctcgcccaggccgtctttcacactcaagcagcgcccgaccgccacgacggaacgtgcaacggcggccttcgctggcaggtgcctccgaccaacgcgggatacaactataagaacaccatcgccaacgcctgcttcttcaacctgggcgcccgcctggcccgctacaccgagaaccagacgtacgccgactgggccagcaagacgttccagtggctctgggacgtaggctacatcgaccacgagagctggaaggtctacgacggcggtcatgtcgagcacaactgcaccgacatcaacaaggcccagttcagctacaacgccgccctgctccttcacgggtccgccttcatgtacaactacaccaacggcagcgagatctggagggagcgcgtcgacaagctgctcgagggcatcctccgcgacttcttccccgacggcgtcgccttcgagctgccctgcgagggccgcaagggcgcctgcaccgccgacatgctgtccttcaagggctacgtccaccgctggatggcggtggtgaccaagctggtgcccgacacggccgggaccatcctgcccgtgctgcggacctcggccgaggcggccgcgaggcagtgcacgggcggcgacacgggccgccgctgcggcttctactggtccgagggcgtcttcgtcgacccggccgtcgacaagaccagcggcgccggcgaggccatgagcgtgctcgccgccgtgtccagcttgctcatcgacgaggcgcccccgccggccaccaacgccaccggcatcagcaggggcgatcccaacgccggcagccgcagccgcggcccttcggagccgctcgcgcccatcaccactgccgatcgggccggcgcgggcatcctgaccatgttgatccttggcggtttcattggtacctggagctggatgagcatcggtgat

SEQ ID NO: 205 - DNA, 3101 bp, Chrysosporium lucknowense
  CDS (110)..(357)
  CDS (462)..(1335)
  CDS (1442)..(1810)
  CDS (1937)..(2698)
gcacaaagagatctgtgtgtgcagtctaggagcgcgcatcgatcggtaacggcacagggacctctcctcctccctctcctcttctgtcctctccttttttttgggagtcatgaagggcacatcggcgttgcagctccttcttgctgtcgccgcggcggtggcccccgccggggcggcgacggcgtggaaaaatgtcaacattggcggcggcggcggcttcgtcccgggcatcatcttccaccccaaggaaaagggggtggcatatgcccggaccgacattggcggtctctaccggctgaaccccgacgacgactcgtggaccccgctgacggataacctgggcaccaacgagaaatggtatatctatctatctatctatctatctatatatatatatatatatatatatatatatgtacatatacataactctgcggaactgacgctgactgaactaacaggggccgctggggtatcgatgccgtcgccgtcgacccccaggatgccgacagggtctacgcggccgtcggcatgtacactaacgactgggaccccaacccgggctccatcatccgcagctcggacaggggcgccacctgggaagtcaccgagctacccttcaaggtgggcgggaacatgccgggccgcgggatgggcgagaggctcgcggtcgacccggccaactcggacatactgttcttcggcgcccgcagcggcaacggcctgtggaagagcgccgacggcggcgtcacctgggcccgcgtcgagtccttcaccaacgtaggcacctacgcgcccgacccaagcgacgccaccggcctgaactcggacctgatcggcctgacctttgtcacgttcgactcgacctcgaacgtggtcggcggcgccacctcgcgcatctttgtcggcacggccgacaacaagaccgcctcggtctacgtgtcggaggacgccggcgccacctggaagcccgtcgagggccagccgggcgccttcttcccgcacaagtgcgtgctgcagcccgaggagaaggcgctctacctgagctacagcaacggcgccggcccctacgacggcaccctgggcgccgtctaccgctacgacctcgccgcccgcacctggaccgacatcaccccggcctcgggcggcgacctctacttcggcttcggtggcctcagcgtcgacttgcggaagccgggcaccctcatggtcgccaccctgaactcgtggtggcccgacgcccagatctaccgctcgaccgactcgggcgccacctggtccaagatctgggagtgggcggcctatccggacatgaactggtactacggtctctatgtacgcgcgtttcttccatcttctctcctttcttcagttttatatatatatatatatatatatatatatatatatatatgtattattgtttctaacttacgtttagaccgataaagccccctggatcaacgccggcttcatctcccaggacaccaagcgtctcggctggatgatcgaggccctcgagatcgactcccacgacagcgaccactggctgtacggaaccggcctcaccctctacggcggccatgaccttaccaagtgggacaccgtgactcgcaacgtcaccatctcgtcgctcgccgccggcatcgaggagatggccgtcctcggcctcgcctcgccccccaacggatccgaactcctggccgccgtgggcgacgactgtggcttcaccttccggaagagccaagacctcggcacgtcccctcagactccctggatgaatcccatctggacttcgaccaccgacgtcggtgagtacatctctctatattcctcctcatcctcctcatcccccctttcctgtctccgctgtttatgttgcatcattgatccgctgacccgcgagatccaccctccctcctcccccccaaaaaaagactacgccggcaacgagcccgatcacgtcgtccgcgtcggcaactctcagggcgccccgcaggtcgccgtgtccgaggatggcggcgtgacctggagcgcgcacccgggcgccgacggcaccaccaactcgggcacgctggcctactcggccgacgcggacacgatcgtctggtcgtctggcagcgccggcgtactccgctcccagaaccagggcgccttcgccgccgttggctccctcccctcgggcgccactgtcgccgccgaccggcgcaacaacaccgtcttctacgccgcctcgggcgcctccttctaccgcagcaccgacacgggcgccacctttgccaaggtcgcctccgcctttggcagcaaggtcgccgccgtcaaagccattgcggcccacccggtcgttgctggcgaggtctgggtcgccaccgacgccggcctgttccgcagcatcgactacggtgccaccttctcggccgcctccggcagcatcaccgatgccatccaggtctccctcggcaagggtgatggctccgcctggaacgtctacgttttcggcacgggccccgagggcaccaagctgtacgcctcggccgacgagggcgccacctgggtcgacatccagggcgagcagggcttcggctcgctctctgccaacaggctcgtcggcagcggcaacgtcgccggccaggtctacgtcggcaccaacggccgcggcgtcttttacgccaaggtatccctgtccgccgccgccaactaaactcggcttccttctttggccgcgcggactgaggaggaggaaatactaggaaggaggaaaaagggggggagggggaagcaatcaaagggaggtcagctgggtcatactaagttggaaacacgctattccatccaactttgcagattttgagtttctcttctttcatcgtatatatgcactttcagggaagagtacatacgtcagtttatatatatatgtatatgtatatattcagaacataaacacaatgttgtctccagtgttttaagggcctggagatcatctcgcttcttactctctcgtatttactcctattggccattggctgccttgaaaaagtccgacaacgcgaagccctcgcgtgctacagcggtgatcgtgccttgcttaacctatcaca

SEQ ID NO: 206 - protein, 751 aa, Chrysosporium lucknowense
MKGTSALQLLLAVAAAVAPAGAATAWKNVNIGGGGGFVPGIIFHPKEKGVAYARTDIGGLYRLNPDDDSWTPLTDNLGTNEKWGRWGIDAVAVDPQDADRVYAAVGMYTNDWDPNPGSIIRSSDRGATWEVTELPFKVGGNMPGRGMGERLAVDPANSDILFFGARSGNGLWKSADGGVTWARVESFTNVGTYAPDPSDATGLNSDLIGLTFVTFDSTSNVVGGATSRIFVGTADNKTASVYVSEDAGATWKPVEGQPGAFFPHKCVLQPEEKALYLSYSNGAGPYDGTLGAVYRYDLAARTWTDITPASGGDLYFGFGGLSVDLRKPGTLMVATLNSWWPDAQIYRSTDSGATWSKIWEWAAYPDMNWYYGLYTDKAPWINAGFISQDTKRLGWMIEALEIDSHDSDHWLYGTGLTLYGGHDLTKWDTVTRNVTISSLAAGIEEMAVLGLASPPNGSELLAAVGDDCGFTFRKSQDLGTSPQTPWMNPIWTSTTDVDYAGNEPDHVVRVGNSQGAPQVAVSEDGGVTWSAHPGADGTTNSGTLAYSADADTIVWSSGSAGVLRSQNQGAFAAVGSLPSGATVAADRRNNTVFYAASGASFYRSTDTGATFAKVASAFGSKVAAVKAIAAHPVVAGEVWVATDAGLFRSIDYGATFSAASGSITDAIQVSLGKGDGSAWNVYVFGTGPEGTKLYASADEGATWVDIQGEQGFGSLSANRLVGSGNVAGQVYVGTNGRGVFYAKVSLSAAAN

SEQ ID NO: 207 - DNA, 2253 bp, Chrysosporium lucknowense
atgaagggcacatcggcgttgcagctccttcttgctgtcgccgcggcggtggcccccgccggggcggcgacggcgtggaaaaatgtcaacattggcggcggcggcggcttcgtcccgggcatcatcttccaccccaaggaaaagggggtggcatatgcccggaccgacattggcggtctctaccggctgaaccccgacgacgactcgtggaccccgctgacggataacctgggcaccaacgagaaatggggccgctggggtatcgatgccgtcgccgtcgacccccaggatgccgacagggtctacgcggccgtcggcatgtacactaacgactgggaccccaacccgggctccatcatccgcagctcggacaggggcgccacctgggaagtcaccgagctacccttcaaggtgggcgggaacatgccgggccgcgggatgggcgagaggctcgcggtcgacccggccaactcggacatactgttcttcggcgcccgcagcggcaacggcctgtggaagagcgccgacggcggcgtcacctgggcccgcgtcgagtccttcaccaacgtaggcacctacgcgcccgacccaagcgacgccaccggcctgaactcggacctgatcggcctgacctttgtcacgttcgactcgacctcgaacgtggtcggcggcgccacctcgcgcatctttgtcggcacggccgacaacaagaccgcctcggtctacgtgtcggaggacgccggcgccacctggaagcccgtcgagggccagccgggcgccttcttcccgcacaagtgcgtgctgcagcccgaggagaaggcgctctacctgagctacagcaacggcgccggcccctacgacggcaccctgggcgccgtctaccgctacgacctcgccgcccgcacctggaccgacatcaccccggcctcgggcggcgacctctacttcggcttcggtggcctcagcgtcgacttgcggaagccgggcaccctcatggtcgccaccctgaactcgtggtggcccgacgcccagatctaccgctcgaccgactcgggcgccacctggtccaagatctgggagtgggcggcctatccggacatgaactggtactacggtctctataccgataaagccccctggatcaacgccggcttcatctcccaggacaccaagcgtctcggctggatgatcgaggccctcgagatcgactcccacgacagcgaccactggctgtacggaaccggcctcaccctctacggcggccatgaccttaccaagtgggacaccgtgactcgcaacgtcaccatctcgtcgctcgccgccggcatcgaggagatggccgtcctcggcctcgcctcgccccccaacggatccgaactcctggccgccgtgggcgacgactgtggcttcaccttccggaagagccaagacctcggcacgtcccctcagactccctggatgaatcccatctggacttcgaccaccgacgtcgactacgccggcaacgagcccgatcacgtcgtccgcgtcggcaactctcagggcgccccgcaggtcgccgtgtccgaggatggcggcgtgacctggagcgcgcacccgggcgccgacggcaccaccaactcgggcacgctggcctactcggccgacgcggacacgatcgtctggtcgtctggcagcgccggcgtactccgctcccagaaccagggcgccttcgccgccgttggctccctcccctcgggcgccactgtcgccgccgaccggcgcaacaacaccgtcttctacgccgcctcgggcgcctccttctaccgcagcaccgacacgggcgccacctttgccaaggtcgcctccgcctttggcagcaaggtcgccgccgtcaaagccattgcggcccacccggtcgttgctggcgaggtctgggtcgccaccgacgccggcctgttccgcagcatcgactacggtgccaccttctcggccgcctccggcagcatcaccgatgccatccaggtctccctcggcaagggtgatggctccgcctggaacgtctacgttttcggcacgggccccgagggcaccaagctgtacgcctcggccgacgagggcgccacctgggtcgacatccagggcgagcagggcttcggctcgctctctgccaacaggctcgtcggcagcggcaacgtcgccggccaggtctacgtcggcaccaacggccgcggcgtcttttacgccaaggtatccctgtccgccgccgccaac

SEQ ID NO: 208 - DNA, 3008 bp, Chrysosporium lucknowense
  CDS (103)..(2736)
gtgtaaaggcgggcgacgatccccgagcgccatccgacatgggcacgccagcggcaccaacccaacgactcgactcgtcgcacaaaccgagtcaagaccatgatgaggatgcggagcttactggtgctcgcggccatcggcctggccgctgccgaggacggcctcaacggctggcttcgctatgcgcggatcaagggagcacgcgatttccacgacaggctgccgtctaccattgtcgcactcaacgccaccgaggggctccccgtctacacggccggccaggagctcgcccagggcatcgagggcatcttcggcaagaaggtcgacctcgacgtcgacctcgcaacggccggcgccggcaagagtaacggcaagggcaagggcaatggcaagggcaaaggaaagggcaacaacggccacggccacgaccgcgacaccaccgccacggttgggacggtcgcggcgtatgtcgacagcaaccccggcgctgctgccgccggcatccccgagctggccgacgacggcttctacctccgggtctcgcgcggtaacgtcctgatcctcggccagaacgagcgcggcgccctgtacggcgccttccactacctctcgctgctcgcgcagggcaacgcatccgactacacgctggcgtccaacccggacgcgccgatccggtgggtgaaccagtgggacaacatgcaggacggcggcacccacggcagcgtcgagcgcggctacgggggcgactccatcttcttctgggacggcaaggtccgcgacgacctgacccgggccggactctacgcccgcctgctcgcctccatcggcgtcaacgcggtcgtcgtcaacaacgtcaacgccgaccccaagacgctgacgcccgagaacatggacggcctggcccgcatcgccaacgccttccggccctacggcgtccagctgggcgtctcgctcaacttcgcctcgccccagaccctcggcggactcgacagcttcgaccccctggacgagcgagtggtggagtggtggcgggacatcaccgacgccctctacgagcggatccccgacatggccggctacctggtcaaggccagctcggagggccagcccggccccttgacgtacaaccggacgctcgccgacggcgccaacctgttcgcgcgcgccctcaagccgcacggcggccgcgtcctgttccgcgccttcgtctacgaccacaccagcctggacgaggacaaggactggaaggcggaccgggccaaggcggcggtcgagtacttcgacggcctcgacggcaagttcgaggacaacgtggtgatccagatcaagtacggccccatcgacttccaggtgcgcgagcccgcgtcccccctcttctcgcgcctggtccgcaccgcctccgccctcgagctgcagatcacgcaggaatacctcggccagcaggcccacctcgtctacctggcgcccatgtggaaggagatcctcgacttcgacttccgcgtcgacggccggccctcgcgcaccgccgacatcctcaacggcaagcgcttcggccgccgccgcgcgggcggctacgccggcgtcgccaacgtcggcaccaacacgacctggctgggcagccacctggccatgtccaacctgtacgccttcggccgcctcgcctgggacccgtcgtccgagcccgagagcgtcctccgcgactggatccggctgaccttcggcgacgacccgaaggtgctcgacgtcatcacgcgcatgtcgatggcctcgtggccggcctacgagaactacagcggcaacctgggcatccagacgctgaccgacatcctgctgggccactacggcccgaacccggcctcgcaggacggcaacccgtggggccagtggacgcgcgccgacgccgacagcatcggcatggaccgcaccgtctggaacggcaccggcttctcgggccagtacccgcccgaggtcgcggcccggttcgagaggatcgagacgacgccggacgagctgctgctctggttccaccacgtcccctacacgcacgtcctcaagtccggcaagacggtcatccagcacttctacgacgcccactacgagggcagcgccgtggcccagaccttcccgcgcctgtgggagacgctccggggccgggtggacgacgagcggttcgagcacgtcctgttccggctcgagtaccaggccggccacgcgctcgtctggcgcgacagcatcaacaacttctacttcaacaagtccggcatccccgacgcccgcggccgcgtcggccaccacccgtaccgcatcgaggccgagcacatgcggctggacggctacgtcccctacgacgtgagccccttcgaggccgccagcggcgcccgctgcgtcgtgacgcgcgacaactcgaccgccaccgccgccaccgccagcgtcgagctgcgccacgtgcccacgggcacctacgacgtcgccgtcaactactacgacatggccatcggcaactccacctgggagctctacatcggccgccgccgcgtcggccgctggaagggcgacctcgaatacaacctcggccgcgccccgtccccctacatcgacggccagaccgccgcccgcgtcaccttccgccgcgtccacatcgagaggggcagcaccctcaagatcgtcggcaggccggacggcctggagcccgcccccatcgactacgtctccatcctgccgctgggcattgtcgactaattaaggagggggggttgtgttaagaggttaatggtcagctgtttgagggaggatggctaaccttactttactctgcatgatttgcatgtgattagtttaattgtattgcttggagctatctaataatcaatatttacatcatcatatcaagaataaccacaccgctttcttttttagggggttaaattaccacaagagccctggagaggagagaacctcattttgacagtaaatgtaaggtatctattatatatagactacagaacgga

SEQ ID NO: 209 - protein, 878 aa, Chrysosporium lucknowense
MRMRSLLVLAAIGLAAAEDGLNGWLRYARIKGARDFHDRLPSTIVALNATEGLPVYTAGQELAQGIEGIFGKKVDLDVDLATAGAGKSNGKGKGNGKGKGKGNNGHGHDRDTTATVGTVAAYVDSNPGAAAAGIPELADDGFYLRVSRGNVLILGQNERGALYGAFHYLSLLAQGNASDYTLASNPDAPIRWVNQWDNMQDGGTHGSVERGYGGDSIFFWDGKVRDDLTRAGLYARLLASIGVNAVVVNNVNADPKTLTPENMDGLARIANAFRPYGVQLGVSLNFASPQTLGGLDSFDPLDERVVEWWRDITDALYERIPDMAGYLVKASSEGQPGPLTYNRTLADGANLFARALKPHGGRVLFRAFVYDHTSLDEDKDWKADRAKAAVEYFDGLDGKFEDNVVIQIKYGPIDFQVREPASPLFSRLVRTASALELQITQEYLGQQAHLVYLAPMWKEILDFDFRVDGRPSRTADILNGKRFGRRRAGGYAGVANVGTNTTWLGSHLAMSNLYAFGRLAWDPSSEPESVLRDWIRLTFGDDPKVLDVITRMSMASWPAYENYSGNLGIQTLTDILLGHYGPNPASQDGNPWGQWTRADADSIGMDRTVWNGTGFSGQYPPEVAARFERIETTPDELLLWFHHVPYTHVLKSGKTVIQHFYDAHYEGSAVAQTFPRLWETLRGRVDDERFEHVLFRLEYQAGHALVWRDSINNFYFNKSGIPDARGRVGHHPYRIEAEHMRLDGYVPYDVSPFEAASGARCVVTRDNSTATAATASVELRHVPTGTYDVAVNYYDMAIGNSTWELYIGRRRVGRWKGDLEYNLGRAPSPYIDGQTAARVTFRRVHIERGSTLKIVGRPDGLEPAPIDYVSILPLGIVD

SEQ ID NO: 210 - DNA, 2634 bp, Chrysosporium lucknowense
atgaggatgcggagcttactggtgctcgcggccatcggcctggccgctgccgaggacggcctcaacggctggcttcgctatgcgcggatcaagggagcacgcgatttccacgacaggctgccgtctaccattgtcgcactcaacgccaccgaggggctccccgtctacacggccggccaggagctcgcccagggcatcgagggcatcttcggcaagaaggtcgacctcgacgtcgacctcgcaacggccggcgccggcaagagtaacggcaagggcaagggcaatggcaagggcaaaggaaagggcaacaacggccacggccacgaccgcgacaccaccgccacggttgggacggtcgcggcgtatgtcgacagcaaccccggcgctgctgccgccggcatccccgagctggccgacgacggcttctacctccgggtctcgcgcggtaacgtcctgatcctcggccagaacgagcgcggcgccctgtacggcgccttccactacctctcgctgctcgcgcagggcaacgcatccgactacacgctggcgtccaacccggacgcgccgatccggtgggtgaaccagtgggacaacatgcaggacggcggcacccacggcagcgtcgagcgcggctacgggggcgactccatcttcttctgggacggcaaggtccgcgacgacctgacccgggccggactctacgcccgcctgctcgcctccatcggcgtcaacgcggtcgtcgtcaacaacgtcaacgccgaccccaagacgctgacgcccgagaacatggacggcctggcccgcatcgccaacgccttccggccctacggcgtccagctgggcgtctcgctcaacttcgcctcgccccagaccctcggcggactcgacagcttcgaccccctggacgagcgagtggtggagtggtggcgggacatcaccgacgccctctacgagcggatccccgacatggccggctacctggtcaaggccagctcggagggccagcccggccccttgacgtacaaccggacgctcgccgacggcgccaacctgttcgcgcgcgccctcaagccgcacggcggccgcgtcctgttccgcgccttcgtctacgaccacaccagcctggacgaggacaaggactggaaggcggaccgggccaaggcggcggtcgagtacttcgacggcctcgacggcaagttcgaggacaacgtggtgatccagatcaagtacggccccatcgacttccaggtgcgcgagcccgcgtcccccctcttctcgcgcctggtccgcaccgcctccgccctcgagctgcagatcacgcaggaatacctcggccagcaggcccacctcgtctacctggcgcccatgtggaaggagatcctcgacttcgacttccgcgtcgacggccggccctcgcgcaccgccgacatcctcaacggcaagcgcttcggccgccgccgcgcgggcggctacgccggcgtcgccaacgtcggcaccaacacgacctggctgggcagccacctggccatgtccaacctgtacgccttcggccgcctcgcctgggacccgtcgtccgagcccgagagcgtcctccgcgactggatccggctgaccttcggcgacgacccgaaggtgctcgacgtcatcacgcgcatgtcgatggcctcgtggccggcctacgagaactacagcggcaacctgggcatccagacgctgaccgacatcctgctgggccactacggcccgaacccggcctcgcaggacggcaacccgtggggccagtggacgcgcgccgacgccgacagcatcggcatggaccgcaccgtctggaacggcaccggcttctcgggccagtacccgcccgaggtcgcggcccggttcgagaggatcgagacgacgccggacgagctgctgctctggttccaccacgtcccctacacgcacgtcctcaagtccggcaagacggtcatccagcacttctacgacgcccactacgagggcagcgccgtggcccagaccttcccgcgcctgtgggagacgctccggggccgggtggacgacgagcggttcgagcacgtcctgttccggctcgagtaccaggccggccacgcgctcgtctggcgcgacagcatcaacaacttctacttcaacaagtccggcatccccgacgcccgcggccgcgtcggccaccacccgtaccgcatcgaggccgagcacatgcggctggacggctacgtcccctacgacgtgagccccttcgaggccgccagcggcgcccgctgcgtcgtgacgcgcgacaactcgaccgccaccgccgccaccgccagcgtcgagctgcgccacgtgcccacgggcacctacgacgtcgccgtcaactactacgacatggccatcggcaactccacctgggagctctacatcggccgccgccgcgtcggccgctggaagggcgacctcgaatacaacctcggccgcgccccgtccccctacatcgacggccagaccgccgcccgcgtcaccttccgccgcgtccacatcgagaggggcagcaccctcaagatcgtcggcaggccggacggcctggagcccgcccccatcgactacgtctccatcctgccgctgggcattgtcgac

SEQ ID NO: 211 - DNA, 2693 bp, Chrysosporium lucknowense
  CDS (147)..(298)
  CDS (366)..(836)
  CDS (946)..(1029)
  CDS (1123)..(1701)
  CDS (1795)..(1987)
  CDS (2125)..(2607)
gtttataagatggctaattacctccaccataacacacctcttagactctggacacggctgcttgttgtgcttgtatgtacatacttgcgctgtgggcaagcaaaccgaagctcctccgttcagttagactccgtctgctgtccaagatggcatctctctcactccgggctctcctcgggtttgttggcgccacggcagcggtgaccgtgaccgtggccagctctggcggacatgccacttctccgtacatgtacggtatcatgtttgaggacattaaccagagtggcgatggtggcttgtaagtgctggttcgcctctgacgcaaaggggtgggacgttcccgagctgagaagataccctcccaggtacgccgagttgatctcgaaccgggcctttcaaaacgagtcgctaaagtcctggagcgccgtgggcgacagcacgctggcgctcgacaccaccacgccgctgtcgtgggccctgcctcgctcggtccgggtcaaggggggaaagggcaaggccggcctgaggaactcgggctactggggcatcgacgtcaagcacaccgacacgtacaccggcagcttctactcgtacggcgagtacaggggtagcttcaccgcctccctcgtgtccgacatcaccaacgagacgctggccatcaccaagatcaagtccaagtcggtcgccaatgcctggacgaagcacgagttcaagttgcacccgaccaagagcgcggcgaacagcaacaacagcttcgtcctcgagttccgccccagccatgagacggagctcaagttcaacctgatcagcctcttccccccaacatacaacaacaggtgagctagctccctcccttccaatccaagtctttgtctctcgtccggcagaccgttttccccaccagagcttcttctgttctgacactacatgtcccatgtctctcaggccgaacggtatgcgccgggacttgatggagaagctccgtgacctcaagccgagtttccttcggatacctggcggcaacaacctgtaagccatcctccatcttccaagtcggcacacgtgtgtggcgtagacttttgggcggccctccctgacaccaagtgatttaaaacaaaacagcgagggcaactttgccggcaaccactggaactggtccgccacgatcggcccgctgattgagcggcccggccgcatgggcgtgtgggggtacgagaacacggatgggctcggcctggtcgagtacatgcactgggcggaggacttgggcgtcgacgtcgtgctcggggtggccgcgggtctctacctgaacggcgacgtcgttcccgaggaggagctggacttcttcgtgcaggacgcgctcaacgagctcgagttcctgatgggcgacgtctcgactccgtacggcgccctgcgcgccaagctcggctaccccaggccgtggaagatcaagttcgtcgagatcggcaacgaagacaacctctggggcggcctcgactcgtacaagagctaccgactgagggccttctacgacgccatcaaggccaagtacccggacatcttcatcttctcatcgaccgacgaggtcgtctacaagaagtcgggccgcgattaccacaagtacacgcgtccggactactccgtctcccagttccacctgtttgacaactggactgcggagcaccccgtcctcatcggcgagtgagtattaattgattaattagtcgagactcacggcgctctctccttgcccacattccggctgtgagctgacgagagtgaccttttccgcaggtacgccaccatccagaacaacacgggcaagctcgaggacacggactgggacgcgcccaagaacgcgtggtccaactggatcggctccgtcgccgaggccgtcttcctgctcggcgccgagcgcaacgccgacaagatctggggcaccgccttcgcgccgctgttccagaacctcaacaactaccagtgggccgtaggtcactctcctttcccccctttccccccctttccctccccacttcccccttttcaccaacgggttggaggtgggtcgtcgaatgatacatgcggtggctgatgacacggggttcgacgacggcacgaacacagcccgacctgatctccttcaccgccgacccggccgacaccaccgtcagcgtgtcgtaccccatcatccagctcttctcggagcaccgcatcacccacaccctcccggccgcgtccccggacgggttcggcccgctgtactgggccgccggtcgcggcggcctcggcggcggcggcggcggcggcggcggcggcggcggtcacgtgtcctcctcctcctcctcctacatcctcaaggtggccgtttacaacagcaccgggtccgaggacgtgccggtgagcgtgcgcttcgagggcctcccgaagggcagccccgcaaccctgacggtgctgacggcggccggcagcgacccctgggccaagaacacgcctggccgtcccgacgccgtcaacaagaccatccagcacctgcgggctggcaagcacggcgagatcgacttcagcctgcccgacctgtcggtcgccgtcttggttgcgcgggggaagtgatgcaggtccttttttttttctctctctgtttcttccctgttagatattcaaaggagagggtagggggtggagggaaaagaaaa

SEQ ID NO: 212 - protein, 654 aa, Chrysosporium lucknowense
MASLSLRALLGFVGATAAVTVTVASSGGHATSPYMYGIMFEDINQSGDGGLYAELISNRAFQNESLKSWSAVGDSTLALDTTTPLSWALPRSVRVKGGKGKAGLRNSGYWGIDVKHTDTYTGSFYSYGEYRGSFTASLVSDITNETLAITKIKSKSVANAWTKHEFKLHPTKSAANSNNSFVLEFRPSHETELKFNLISLFPPTYNNRPNGMRRDLMEKLRDLKPSFLRIPGGNNLEGNFAGNHWNWSATIGPLIERPGRMGVWGYENTDGLGLVEYMHWAEDLGVDVVLGVAAGLYLNGDVVPEEELDFFVQDALNELEFLMGDVSTPYGALRAKLGYPRPWKIKFVEIGNEDNLWGGLDSYKSYRLRAFYDAIKAKYPDIFIFSSTDEVVYKKSGRDYHKYTRPDYSVSQFHLFDNWTAEHPVLIGEYATIQNNTGKLEDTDWDAPKNAWSNWIGSVAEAVFLLGAERNADKIWGTAFAPLFQNLNNYQWAPDLISFTADPADTTVSVSYPIIQLFSEHRITHTLPAASPDGFGPLYWAAGRGGLGGGGGGGGGGGGHVSSSSSSYILKVAVYNSTGSEDVPVSVRFEGLPKGSPATLTVLTAAGSDPWAKNTPGRPDAVNKTIQHLRAGKHGEIDFSLPDLSVAVLVARGK

SEQ ID NO: 213 - DNA, 1962 bp, Chrysosporium lucknowense
atggcatctctctcactccgggctctcctcgggtttgttggcgccacggcagcggtgaccgtgaccgtggccagctctggcggacatgccacttctccgtacatgtacggtatcatgtttgaggacattaaccagagtggcgatggtggcttgtacgccgagttgatctcgaaccgggcctttcaaaacgagtcgctaaagtcctggagcgccgtgggcgacagcacgctggcgctcgacaccaccacgccgctgtcgtgggccctgcctcgctcggtccgggtcaaggggggaaagggcaaggccggcctgaggaactcgggctactggggcatcgacgtcaagcacaccgacacgtacaccggcagcttctactcgtacggcgagtacaggggtagcttcaccgcctccctcgtgtccgacatcaccaacgagacgctggccatcaccaagatcaagtccaagtcggtcgccaatgcctggacgaagcacgagttcaagttgcacccgaccaagagcgcggcgaacagcaacaacagcttcgtcctcgagttccgccccagccatgagacggagctcaagttcaacctgatcagcctcttccccccaacatacaacaacaggccgaacggtatgcgccgggacttgatggagaagctccgtgacctcaagccgagtttccttcggatacctggcggcaacaacctcgagggcaactttgccggcaaccactggaactggtccgccacgatcggcccgctgattgagcggcccggccgcatgggcgtgtgggggtacgagaacacggatgggctcggcctggtcgagtacatgcactgggcggaggacttgggcgtcgacgtcgtgctcggggtggccgcgggtctctacctgaacggcgacgtcgttcccgaggaggagctggacttcttcgtgcaggacgcgctcaacgagctcgagttcctgatgggcgacgtctcgactccgtacggcgccctgcgcgccaagctcggctaccccaggccgtggaagatcaagttcgtcgagatcggcaacgaagacaacctctggggcggcctcgactcgtacaagagctaccgactgagggccttctacgacgccatcaaggccaagtacccggacatcttcatcttctcatcgaccgacgaggtcgtctacaagaagtcgggccgcgattaccacaagtacacgcgtccggactactccgtctcccagttccacctgtttgacaactggactgcggagcaccccgtcctcatcggcgagtacgccaccatccagaacaacacgggcaagctcgaggacacggactgggacgcgcccaagaacgcgtggtccaactggatcggctccgtcgccgaggccgtcttcctgctcggcgccgagcgcaacgccgacaagatctggggcaccgccttcgcgccgctgttccagaacctcaacaactaccagtgggcccccgacctgatctccttcaccgccgacccggccgacaccaccgtcagcgtgtcgtaccccatcatccagctcttctcggagcaccgcatcacccacaccctcccggccgcgtccccggacgggttcggcccgctgtactgggccgccggtcgcggcggcctcggcggcggcggcggcggcggcggcggcggcggcggtcacgtgtcctcctcctcctcctcctacatcctcaaggtggccgtttacaacagcaccgggtccgaggacgtgccggtgagcgtgcgcttcgagggcctcccgaagggcagccccgcaaccctgacggtgctgacggcggccggcagcgacccctgggccaagaacacgcctggccgtcccgacgccgtcaacaagaccatccagcacctgcgggctggcaagcacggcgagatcgacttcagcctgcccgacctgtcggtcgccgtcttggttgcgcgggggaag

SEQ ID NO: 214 - DNA, 2686 bp, Chrysosporium lucknowense
  CDS (38)..(193)
  CDS (331)..(2367)
ctaagcgtaacaactttccacgcccacgcacaactccatggccttcctttcctcctttgcccttgccgccctcggggcactcgtcgtcccggcgaggggcggcgtgacgtacccggactgcgcaaacggaccgctcaagtcaaatacggtgtgcgatacgtcggcgtccccgggagcccgagccgctgctcttgtgagtgtaatgaacaacaacgaaaaacttgcaaatcttgtcaagtatttctctcccgtgctttgtcaacattcatgggctgacaatcagccagcaattcgcccggcgtctcgcggctcggcctgagtgcgtaccagtggtggaacgaagccctccacggagtagcccataaccgcggcattacctggggcggcgagttcagcgcggcaacccagttcccgcaggctatcacgacttccgccactttcgatgacgctttgatcgagcaaatcggcaccattatcagcaccgaggcccgtgcctttgccaacaatgggcgcgctcatctcgacttctggacgcccaacgtcaacccgtttcgagacccgcgatggggtcgcggacacgagacgccgggagaggatgcattcaagaataagaagtgggccgaggccttcgtcaagggcatgcaaggacccggaccgacgcaccgagtcatcgccacatgtaagcactacgccgcctacgacctcgagaactccgggagcacgacccgattcaacttcgatgcgaaggtgtcaactcaagatctcgccgagtactatctccctccgttccaacagtgcgcccgggactctaaggtgggctccatcatgtgcagctacaatgcggtcaatgaaatcccggcctgcgcgaatccttacctgatggataccatcctgcggaaacattggaattggaccgacgagcaccagtatattgtgagcgactgcgatgccgtgtactatctcggcaatgcgaacggcggccaccgatacaagccgagctatgcggcggcgatcggagcatctctcgaggctggttgcgataacatgtgctgggcgaccggcggcaccgccccggatcccgcctcagccttcaattccggccagttcagccagacgacactggacacggctattttgcgccagatgcagggcctcgtcctagcgggatactttgacggtccgggcggtatgtaccgcaacctgagcgtggcggacgtgaacacgcagaccgcccaggacactgcactcaaggcggcggaaggaggcatcgtgctcctcaagaacgatgggatccttccgctgtcggttaacggttccaatttccaggtcgctatgatcgggttctgggcgaacgcagccgacaagatgctcgggggttacagcgggagcccgccgttcaaccatgatcccgtgaccgctgcaagatcgatgggcatcacggtcaactacgtcaacgggccattgacgcaacccaacggggatacgtcggcagcactcaatgcggcccaaaagtccaacgcggtggtattctttggtggaatcgacaatacggtggagaaggagagtcaggacagaacgtccatcgagtggccctcagggcaactggctctgattcggaggctagccgaaaccggcaaaccagtcatcgtcgtcaggctcgggacgcacgtcgacgacaccccgctcctcagcattccgaatgtgagagccattttgtgggcaggatacccgggtcaagacggcgggactgctgtggtgaaaatcattaccggccttgctagtccggcggggaggctgcccgccactgtgtatccgtcttcgtacaccagccaagcgccctttacaaacatggccctgaggccttcttcgtcctatcccgggcgaacataccgctggtacagtaacgccgtctttccatttggccacggcctacattataccaatttcagtgtctcggtgcgggactttccggccagcttcgcgattgccgatctcctggcttcctgcggggattccgtggcgtatcttgatctttgccccttcccgtccgtgtcgctcaatgtgaccaatacaggcacccgcgtgtccgattacgttgcgcttgggttcttgtcgggagattttggtcccagcccacatcccatcaagacattggcgacgtataagcgcgtgtttaacatcgaacctggggaaacacaggtggccgagctagactggaagctggagagcctggtccgggtagatgagaagggcaacagggtactctaccccggaacatatacgcttcttgtggatcagccaaccttggcaaatatcacctttattttgacaggagaagaggcagtgttggatagttggccgcagccgtgaggccgagagcgctcgattgatgagacatcttctcagtgacgagaaatctagctaatatttcttgtctatgttatacctttcagaagctatcgaaacccgctgccctgaacaagtaccgtatctacctatataagcttagccaccgtcaccacctcggcggcctagtagatagcggggcattcaatggaccctgttcttgggcttgcttagctctgtggggggagccgatcatacggagtacacagaatcgcgagcattgccggcgacctgtgccagccgccgtacggatccatgcccggcctgcgaaggcaaaaaa

SEQ ID NO: 215 - protein, 731 aa, Chrysosporium lucknowense
MAFLSSFALAALGALVVPARGGVTYPDCANGPLKSNTVCDTSASPGARAAALWWNEALHGVAHNRGITWGGEFSAATQFPQAITTSATFDDALIEQIGTIISTEARAFANNGRAHLDFWTPNVNPFRDPRWGRGHETPGEDAFKNKKWAEAFVKGMQGPGPTHRVIATCKHYAAYDLENSGSTTRFNFDAKVSTQDLAEYYLPPFQQCARDSKVGSIMCSYNAVNEIPACANPYLMDTILRKHWNWTDEHQYIVSDCDAVYYLGNANGGHRYKPSYAAAIGASLEAGCDNMCWATGGTAPDPASAFNSGQFSQTTLDTAILRQMQGLVLAGYFDGPGGMYRNLSVADVNTQTAQDTALKAAEGGIVLLKNDGILPLSVNGSNFQVAMIGFWANAADKMLGGYSGSPPFNHDPVTAARSMGITVNYVNGPLTQPNGDTSAALNAAQKSNAVVFFGGIDNTVEKESQDRTSIEWPSGQLALIRRLAETGKPVIVVRLGTHVDDTPLLSIPNVRAILWAGYPGQDGGTAVVKIITGLASPAGRLPATVYPSSYTSQAPFTNMALRPSSSYPGRTYRWYSNAVFPFGHGLHYTNFSVSVRDFPASFAIADLLASCGDSVAYLDLCPFPSVSLNVTNTGTRVSDYVALGFLSGDFGPSPHPIKTLATYKRVFNIEPGETQVAELDWKLESLVRVDEKGNRVLYPGTYTLLVDQPTLANITFILTGEEAVLDSWPQP

SEQ ID NO: 216 - DNA, 2193 bp, Chrysosporium lucknowense
atggccttcctttcctcctttgcccttgccgccctcggggcactcgtcgtcccggcgaggggcggcgtgacgtacccggactgcgcaaacggaccgctcaagtcaaatacggtgtgcgatacgtcggcgtccccgggagcccgagccgctgctctttggtggaacgaagccctccacggagtagcccataaccgcggcattacctggggcggcgagttcagcgcggcaacccagttcccgcaggctatcacgacttccgccactttcgatgacgctttgatcgagcaaatcggcaccattatcagcaccgaggcccgtgcctttgccaacaatgggcgcgctcatctcgacttctggacgcccaacgtcaacccgtttcgagacccgcgatggggtcgcggacacgagacgccgggagaggatgcattcaagaataagaagtgggccgaggccttcgtcaagggcatgcaaggacccggaccgacgcaccgagtcatcgccacatgtaagcactacgccgcctacgacctcgagaactccgggagcacgacccgattcaacttcgatgcgaaggtgtcaactcaagatctcgccgagtactatctccctccgttccaacagtgcgcccgggactctaaggtgggctccatcatgtgcagctacaatgcggtcaatgaaatcccggcctgcgcgaatccttacctgatggataccatcctgcggaaacattggaattggaccgacgagcaccagtatattgtgagcgactgcgatgccgtgtactatctcggcaatgcgaacggcggccaccgatacaagccgagctatgcggcggcgatcggagcatctctcgaggctggttgcgataacatgtgctgggcgaccggcggcaccgccccggatcccgcctcagccttcaattccggccagttcagccagacgacactggacacggctattttgcgccagatgcagggcctcgtcctagcgggatactttgacggtccgggcggtatgtaccgcaacctgagcgtggcggacgtgaacacgcagaccgcccaggacactgcactcaaggcggcggaaggaggcatcgtgctcctcaagaacgatgggatccttccgctgtcggttaacggttccaatttccaggtcgctatgatcgggttctgggcgaacgcagccgacaagatgctcgggggttacagcgggagcccgccgttcaaccatgatcccgtgaccgctgcaagatcgatgggcatcacggtcaactacgtcaacgggccattgacgcaacccaacggggatacgtcggcagcactcaatgcggcccaaaagtccaacgcggtggtattctttggtggaatcgacaatacggtggagaaggagagtcaggacagaacgtccatcgagtggccctcagggcaactggctctgattcggaggctagccgaaaccggcaaaccagtcatcgtcgtcaggctcgggacgcacgtcgacgacaccccgctcctcagcattccgaatgtgagagccattttgtgggcaggatacccgggtcaagacggcgggactgctgtggtgaaaatcattaccggccttgctagtccggcggggaggctgcccgccactgtgtatccgtcttcgtacaccagccaagcgccctttacaaacatggccctgaggccttcttcgtcctatcccgggcgaacataccgctggtacagtaacgccgtctttccatttggccacggcctacattataccaatttcagtgtctcggtgcgggactttccggccagcttcgcgattgccgatctcctggcttcctgcggggattccgtggcgtatcttgatctttgccccttcccgtccgtgtcgctcaatgtgaccaatacaggcacccgcgtgtccgattacgttgcgcttgggttcttgtcgggagattttggtcccagcccacatcccatcaagacattggcgacgtataagcgcgtgtttaacatcgaacctggggaaacacaggtggccgagctagactggaagctggagagcctggtccgggtagatgagaagggcaacagggtactctaccccggaacatatacgcttcttgtggatcagccaaccttggcaaatatcacctttattttgacaggagaagaggcagtgttggatagttggccgcagccg

SEQ ID NO: 217 - DNA, 1983 bp, Chrysosporium lucknowense
  CDS (185)..(1933)
acatatatatatatatatatatgtatatcccgctctcgcagtggtacgtaccgtgaggtgactcccctctcctctccccccttttctcctctggactgcccaaccgagaactcggtgatctcttaaccgcctgtggcctctttttctgtttggtttgtgaataatgcccgcccctcgcaccacgatgacgatgctcaagtcggccctccccgcggcgctggccctcctcctaacggcggccaacggccacccttccaggaccccggcggcggcggcggcggggggatgggcaccgctggcgaatgggacattccggaacccgatcctgtacgaggacttcccggacaacgacgtgtcggtcgggccggacggggccttctacctgtcggcgtccaacttccacttcagccccggggcgcccatcctgcggtcttacgacctggtcgactgggagtttgtgggccactcgatcccgcgcctcgacttcggcgccggctacgacctgccgccgacgggcgagcgggcgtaccgcgcgggcacgtgggcgtcgacgctgcggtaccgcgagagcacggggctctggtactggatcgggtgcaccaacttctggcgcacctgggtcttcaccgccccggcgcccgaggggccctggacccgggcgggcgacttcggcgacggcgtgtgcttctacgacaacggcctgctggtcgacgacgacgacaccatgtacgtcgtctacacccacgacggcggcaagcgggtcaacgtgacccagctgagcgcggacgggctgagcgccgtccgcaccgagaccgtcctggtgccggagcaggccggcgtcgacgccctcgagggcaaccgcatgtacaagatcgacggccgctactacatcctcaacgaccacccgggcaccaccgcctacgtctggaagtccgactcgccctggggtccctacgagggcaaggcgctggccgacaacgtcgccagccccctgcccggcggcggcgccccgcaccagggcagcctggtgcccacgccctcgggcgcctggtactttatgtccttcacctgggcctacccgtccggccgcctgcccgtgctggccccgatcgagttccagccggacgggttcccgaccctcgtcaccgccaacgacaacaacaacaacaacaacaacaacgcctggggcgccagctacccgctgccgccgctaccgcgccggccgctgggctacccgtggtcgcgggcgcggtacgacttcagcgcgctcgccgaactgccgcccgcgttcgagtggaaccacaacccggacgcgagcaactacacgctgggagggaacggcgctgccggcctgatcctgcgggccgccaccgtcgcgcccgacgacgacctgtactcggcgcgcaacacgctgacgcaccgcgcccacgggcccttcccctcggccacgctggtcctcgacgtcgcggacatggccgacggcgaccgcgccgggctggccgccttccgcgaccgcagtgcctacatcggcatccactgctcctcctcctctgatgagaagaagaagaagacgtacgaggtggtggcgcgattcaacatgacgctggacgagtggggcagcggcgagacgctcgatctgggcgaggtggtggagcgggtcgagctggcctcgggcgtgacgcgcgtgtggctgcgggcgagcatggacgcgcggcccgacggcgagcggacggcccggttcgggtacagcgtcgacgggggcgagacctttgccggcctggggcccgcctaccaactctacgccgggtggcccttctttgtcggctaccgcttcgccgtcttcaactacgccaccaaggccctcggcgggagcgtcaccgtcctgagcctcgagaccgactcgggcgagggtgagcgcgatgccgagcaagcgtgaggtttggtttgaggggaaaagaaaaacaaaagtgagaaaccaataaa

SEQ ID NO: 218 - protein, 583 aa, Chrysosporium lucknowense
MTMLKSALPAALALLLTAANGHPSRTPAAAAAGGWAPLANGTFRNPILYEDFPDNDVSVGPDGAFYLSASNFHFSPGAPILRSYDLVDWEFVGHSIPRLDFGAGYDLPPTGERAYRAGTWASTLRYRESTGLWYWIGCTNFWRTWVFTAPAPEGPWTRAGDFGDGVCFYDNGLLVDDDDTMYVVYTHDGGKRVNVTQLSADGLSAVRTETVLVPEQAGVDALEGNRMYKIDGRYYILNDHPGTTAYVWKSDSPWGPYEGKALADNVASPLPGGGAPHQGSLVPTPSGAWYFMSFTWAYPSGRLPVLAPIEFQPDGFPTLVTANDNNNNNNNNAWGASYPLPPLPRRPLGYPWSRARYDFSALAELPPAFEWNHNPDASNYTLGGNGAAGLILRAATVAPDDDLYSARNTLTHRAHGPFPSATLVLDVADMADGDRAGLAAFRDRSAYIGIHCSSSSDEKKKKTYEVVARFNMTLDEWGSGETLDLGEVVERVELASGVTRVWLRASMDARPDGERTARFGYSVDGGETFAGLGPAYQLYAGWPFFVGYRFAVFNYATKALGGSVTVLSLETDSGEGERDAEQA

SEQ ID NO: 219 - DNA, 1749 bp, Chrysosporium lucknowense
atgacgatgctcaagtcggccctccccgcggcgctggccctcctcctaacggcggccaacggccacccttccaggaccccggcggcggcggcggcggggggatgggcaccgctggcgaatgggacattccggaacccgatcctgtacgaggacttcccggacaacgacgtgtcggtcgggccggacggggccttctacctgtcggcgtccaacttccacttcagccccggggcgcccatcctgcggtcttacgacctggtcgactgggagtttgtgggccactcgatcccgcgcctcgacttcggcgccggctacgacctgccgccgacgggcgagcgggcgtaccgcgcgggcacgtgggcgtcgacgctgcggtaccgcgagagcacggggctctggtactggatcgggtgcaccaacttctggcgcacctgggtcttcaccgccccggcgcccgaggggccctggacccgggcgggcgacttcggcgacggcgtgtgcttctacgacaacggcctgctggtcgacgacgacgacaccatgtacgtcgtctacacccacgacggcggcaagcgggtcaacgtgacccagctgagcgcggacgggctgagcgccgtccgcaccgagaccgtcctggtgccggagcaggccggcgtcgacgccctcgagggcaaccgcatgtacaagatcgacggccgctactacatcctcaacgaccacccgggcaccaccgcctacgtctggaagtccgactcgccctggggtccctacgagggcaaggcgctggccgacaacgtcgccagccccctgcccggcggcggcgccccgcaccagggcagcctggtgcccacgccctcgggcgcctggtactttatgtccttcacctgggcctacccgtccggccgcctgcccgtgctggccccgatcgagttccagccggacgggttcccgaccctcgtcaccgccaacgacaacaacaacaacaacaacaacaacgcctggggcgccagctacccgctgccgccgctaccgcgccggccgctgggctacccgtggtcgcgggcgcggtacgacttcagcgcgctcgccgaactgccgcccgcgttcgagtggaaccacaacccggacgcgagcaactacacgctgggagggaacggcgctgccggcctgatcctgcgggccgccaccgtcgcgcccgacgacgacctgtactcggcgcgcaacacgctgacgcaccgcgcccacgggcccttcccctcggccacgctggtcctcgacgtcgcggacatggccgacggcgaccgcgccgggctggccgccttccgcgaccgcagtgcctacatcggcatccactgctcctcctcctctgatgagaagaagaagaagacgtacgaggtggtggcgcgattcaacatgacgctggacgagtggggcagcggcgagacgctcgatctgggcgaggtggtggagcgggtcgagctggcctcgggcgtgacgcgcgtgtggctgcgggcgagcatggacgcgcggcccgacggcgagcggacggcccggttcgggtacagcgtcgacgggggcgagacctttgccggcctggggcccgcctaccaactctacgccgggtggcccttctttgtcggctaccgcttcgccgtcttcaactacgccaccaaggccctcggcgggagcgtcaccgtcctgagcctcgagaccgactcgggcgagggtgagcgcgatgccgagcaagcg

SEQ ID NO: 220 - DNA, 3295 bp, Chrysosporium lucknowense
  CDS (191)..(2890)
cctgtattatgacagcccgaggaactcgtggccgtggttggaaattgcgaaatagaccgagggggtgaatgcacacctaggtatatatatgtactgcacatacatacaacgtcgtagtgttttaagcaggcaccacgtacctggagatggcttgtcgcagttacacactagagcatagcgctgtgccatcatgtggttttccaatggtctcaccaatgcctgtgggctcgccttcctaggcgcgctgctgctgtccgtagtagacgcgaagccaatgccaaaggaagggggacgcgacagaatcagcatcaacaccggctggcgcttctaccggagcgagtacaacaccgacaagctggcctacgacctgagccgcaacgactacgcgaaccgcacagatttgaccgtcttgaaaccgtggattctgccctcggctaatgacttcatcgcagacccggccgcacgacaccggcgcccttccggcgagccaaccatcggcatcccctttgtgcggtcgagctacgacgacaccgagtgggagaccgtcgacctgccacacgactgggccatcaagggtccattctacgtcggggacaatgttcccgtcggcggcggcatgggccgcttgcccgtccacggcatcggttggtaccgccgaaaggtggaaatgaccaaggccgacgagggcaggtccatctacctcgacatcgacggagccatgtcgtactcgatcgtctggctcaacggccacctcgtcgggggatggccctacggatactcttcctaccgtctcgacctgacgccttacctcaagctcggcgacgacaatctgttggccatccgcgtcgacaatccagggaactcatcgcgctggtaccccggcggaggcatttaccgcaatgcttggctcaccaagacaagcccgacacacgttgggcagtggggcacctttatcacatcgaggagcgtgtccaaatcgtccgcggtcctcgacctcgccgtccaggtcgagaacgctggagagacctctcagaagctgagcgtggtgacagatgtgtatatcctagactcggcgaccggggaggcccgtacgaaggtggcctcgttcccgcgccagaccatcaccgtcgcggcgggccacaaggtctcggtgaatgcttcgaccactgtcaagaagccagcactgtggggtccaccgccctcgcagtcgccgaatatgcatgttgctgtaacgcgtttatataaccgcaacaacgacatcgttgacacgtacttgaccgactttggcatccgctcggtcgtctatgacgccgatcatggcttgctggttaacggcgagcggatccggatccagggcgtgaacggccaccacgatctcggcgcgctcggggccgccttcaacgtgcgcgcggccgaacgccagctcgaagtgctccaggaactaggctgcaacgctctccgtgtttcccacaacccccctgctcccgaactgctggatctggcagataggatgggcatcctgatctatgacgaggcgttcgacggctggcagctgtccaagaacccgaacgacttccaccttatcttcgacgattggtccgaggccgaccttcgcgccatggtgcgccgcgaccgtaaccacccgtctgtcatcatctggagcattggcaacgaggtcggggagcagaccacgggcgacagcggcgctgccgtggccaggcggctacgccagatcgtccgctccgaggacgagacgcgccccgtaacggcgtccatgaacgcggcccggccgaacatgcccttcccgggggagctcgacctgatcagcctcaactaccaaggcgagggcatccgtgatacgggcccgtacgccggtctgccgggcatcagtacgccgccgctctacctccccttccacgacgccttcccggacaagttgatcgtcagcagcgagacggcggcaaccgtaagcacccgcgggacctacttcttccccatcaccaactggacgagcgcccccgcgaactacacggtcgggagcggcggcaacgacacgctgctccaggtgagcgattacggcctgtatacggccccgtttggctcgtcgcccgacaaggtattcgtggcgcaggacaacgcgtcctttgtgtccggggagtttgtctggtccggctgggactacatcggcgagcccacgccgtactacgcggcgcggagctcgtactttggcatcatcgacctggccgggttcaagaaggaccgcttctaccagtaccaggcccgctggcggccagaccaccccgtcgcccacatcctgccgcactggacctggggggccgaccgcgtcggcgaagtcacgcccgtccacgtcttctccaacggcgaccaggccgagctgtgggtcaacggcaagtcgcagggccgtctgcggcgcgagtccgagtccgtctaccgcttccgctgggacaacgtcacctaccagcccggcgaggtgcgcgttgtcacgtacaggaacggcaagcagtgggccagcgatagggtggtgacggcgggagtgcccgtggcccttcgcctgagagcggaccggtccgcgatcgcgggcgacgggcttgacctgtcattcttgacggccacggtggtggacagcaagggcaatgtggtgccgcaggcggataacgagattaccttcaccgtgtcgggtcgcggcggtggcgagatcgtggcgacggataacggcgacccccgggatttcacatcatttgcgtccaggacgcgcaaggcctttagcgggcttgccttggggattgtgcgtgccaaccggaagggagatatcacggtcacggctagcgcgcccggccttgcccgcgccgtggtcaagttgacggcaaattgaggagaagaagacaaagtcgcaaaggaaagtcctagagaggcaggggtaaagggttgcaggacgcgtgatccgtttgccccgcggcttcccgtcgaggcaaaaccctagagaaaatctgcatcgtaattgagagtaggcgcgaccattacaacagccctagagtagacaaggcttcaagtcggaccttagttgaaccaaacaaaaagtctaatgtagaagatgtttaagtggtgtaacggcaggtgagcacggctcagagaggaagcttgcgaagagtcgtaaatgctaggcgaagcgacgtacggtgctagctatctgatgccagcgaagggggacgatggggagaaacaagttttgctatgctttgcgcatcgtagcggcttgtgggagatgggtaataaa

SEQ ID NO: 221 - protein, 900 aa, Chrysosporium lucknowense
MWFSNGLTNACGLAFLGALLLSVVDAKPMPKEGGRDRISINTGWRFYRSEYNTDKLAYDLSRNDYANRTDLTVLKPWILPSANDFIADPAARHRRPSGEPTIGIPFVRSSYDDTEWETVDLPHDWAIKGPFYVGDNVPVGGGMGRLPVHGIGWYRRKVEMTKADEGRSIYLDIDGAMSYSIVWLNGHLVGGWPYGYSSYRLDLTPYLKLGDDNLLAIRVDNPGNSSRWYPGGGIYRNAWLTKTSPTHVGQWGTFITSRSVSKSSAVLDLAVQVENAGETSQKLSVVTDVYILDSATGEARTKVASFPRQTITVAAGHKVSVNASTTVKKPALWGPPPSQSPNMHVAVTRLYNRNNDIVDTYLTDFGIRSVVYDADHGLLVNGERIRIQGVNGHHDLGALGAAFNVRAAERQLEVLQELGCNALRVSHNPPAPELLDLADRMGILIYDEAFDGWQLSKNPNDFHLIFDDWSEADLRAMVRRDRNHPSVIIWSIGNEVGEQTTGDSGAAVARRLRQIVRSEDETRPVTASMNAARPNMPFPGELDLISLNYQGEGIRDTGPYAGLPGISTPPLYLPFHDAFPDKLIVSSETAATVSTRGTYFFPITNWTSAPANYTVGSGGNDTLLQVSDYGLYTAPFGSSPDKVFVAQDNASFVSGEFVWSGWDYIGEPTPYYAARSSYFGIIDLAGFKKDRFYQYQARWRPDHPVAHILPHWTWGADRVGEVTPVHVFSNGDQAELWVNGKSQGRLRRESESVYRFRWDNVTYQPGEVRVVTYRNGKQWASDRVVTAGVPVALRLRADRSAIAGDGLDLSFLTATVVDSKGNVVPQADNEITFTVSGRGGGEIVATDNGDPRDFTSFASRTRKAFSGLALGIVRANRKGDITVTASAPGLARAVVKLTAN

SEQ ID NO: 222 - DNA, 2700 bp, Chrysosporium lucknowense
atgtggttttccaatggtctcaccaatgcctgtgggctcgccttcctaggcgcgctgctgctgtccgtagtagacgcgaagccaatgccaaaggaagggggacgcgacagaatcagcatcaacaccggctggcgcttctaccggagcgagtacaacaccgacaagctggcctacgacctgagccgcaacgactacgcgaaccgcacagatttgaccgtcttgaaaccgtggattctgccctcggctaatgacttcatcgcagacccggccgcacgacaccggcgcccttccggcgagccaaccatcggcatcccctttgtgcggtcgagctacgacgacaccgagtgggagaccgtcgacctgccacacgactgggccatcaagggtccattctacgtcggggacaatgttcccgtcggcggcggcatgggccgcttgcccgtccacggcatcggttggtaccgccgaaaggtggaaatgaccaaggccgacgagggcaggtccatctacctcgacatcgacggagccatgtcgtactcgatcgtctggctcaacggccacctcgtcgggggatggccctacggatactcttcctaccgtctcgacctgacgccttacctcaagctcggcgacgacaatctgttggccatccgcgtcgacaatccagggaactcatcgcgctggtaccccggcggaggcatttaccgcaatgcttggctcaccaagacaagcccgacacacgttgggcagtggggcacctttatcacatcgaggagcgtgtccaaatcgtccgcggtcctcgacctcgccgtccaggtcgagaacgctggagagacctctcagaagctgagcgtggtgacagatgtgtatatcctagactcggcgaccggggaggcccgtacgaaggtggcctcgttcccgcgccagaccatcaccgtcgcggcgggccacaaggtctcggtgaatgcttcgaccactgtcaagaagccagcactgtggggtccaccgccctcgcagtcgccgaatatgcatgttgctgtaacgcgtttatataaccgcaacaacgacatcgttgacacgtacttgaccgactttggcatccgctcggtcgtctatgacgccgatcatggcttgctggttaacggcgagcggatccggatccagggcgtgaacggccaccacgatctcggcgcgctcggggccgccttcaacgtgcgcgcggccgaacgccagctcgaagtgctccaggaactaggctgcaacgctctccgtgtttcccacaacccccctgctcccgaactgctggatctggcagataggatgggcatcctgatctatgacgaggcgttcgacggctggcagctgtccaagaacccgaacgacttccaccttatcttcgacgattggtccgaggccgaccttcgcgccatggtgcgccgcgaccgtaaccacccgtctgtcatcatctggagcattggcaacgaggtcggggagcagaccacgggcgacagcggcgctgccgtggccaggcggctacgccagatcgtccgctccgaggacgagacgcgccccgtaacggcgtccatgaacgcggcccggccgaacatgcccttcccgggggagctcgacctgatcagcctcaactaccaaggcgagggcatccgtgatacgggcccgtacgccggtctgccgggcatcagtacgccgccgctctacctccccttccacgacgccttcccggacaagttgatcgtcagcagcgagacggcggcaaccgtaagcacccgcgggacctacttcttccccatcaccaactggacgagcgcccccgcgaactacacggtcgggagcggcggcaacgacacgctgctccaggtgagcgattacggcctgtatacggccccgtttggctcgtcgcccgacaaggtattcgtggcgcaggacaacgcgtcctttgtgtccggggagtttgtctggtccggctgggactacatcggcgagcccacgccgtactacgcggcgcggagctcgtactttggcatcatcgacctggccgggttcaagaaggaccgcttctaccagtaccaggcccgctggcggccagaccaccccgtcgcccacatcctgccgcactggacctggggggccgaccgcgtcggcgaagtcacgcccgtccacgtcttctccaacggcgaccaggccgagctgtgggtcaacggcaagtcgcagggccgtctgcggcgcgagtccgagtccgtctaccgcttccgctgggacaacgtcacctaccagcccggcgaggtgcgcgttgtcacgtacaggaacggcaagcagtgggccagcgatagggtggtgacggcgggagtgcccgtggcccttcgcctgagagcggaccggtccgcgatcgcgggcgacgggcttgacctgtcattcttgacggccacggtggtggacagcaagggcaatgtggtgccgcaggcggataacgagattaccttcaccgtgtcgggtcgcggcggtggcgagatcgtggcgacggataacggcgacccccgggatttcacatcatttgcgtccaggacgcgcaaggcctttagcgggcttgccttggggattgtgcgtgccaaccggaagggagatatcacggtcacggctagcgcgcccggccttgcccgcgccgtggtcaagttgacggcaaat

SEQ ID NO: 223 - DNA, 1024 bp, Chrysosporium lucknowense
  CDS (121)..(389)
  CDS (578)..(1016)
aaacccccccctatgctcgatcgtttcgcggggtttcatttgctcgcccgagtcatcaacctccaagctccccttgttcttcacgcctatcacccgacaggaaacgccacctgcccaccaatgttccgcaagaccgctcttctgctcctcgccgccctccccttctccttcgcgcagatctcggaggactttgaaggcggttgggacgagtcggcgtggccgatctacgccaacgactgcaaccagggcggcaaggtgtcgctggacaccaccactgcccacagcggctctaactcggtccgggttgacggcgccggtggttactgcgggcacattttctttggcacgacgtccgtccctagcggtgatctctatgtcaggacatggctgtacgtctgtgatttcctccttcttctcctcaccctcatcctcatcctcatcctcatcctcatcatcaccatgaacttgttttttctcttctaattatgctccccctttctctcgattattatttgcttcgtccaaaggtatgaaaaagaagacatccgctctgacattcgctgcctccccttgacaggaaagcgcaaaacgccctcaccgacgcccacgttagcttcatcaccatgccggactcggcccagggggcgaacaagcacctccggatcggcgggcagagcaagatcctcatgtacaaccgcgagtcggacgacgcgacgctcccggacctgtcgccgcagggcatcgccgcgtcgaaggccctgcccacgggcgactggcagtgcctcgagtaccacgtcggcgccgacggcaccatcgagacgtggctcaacggcgaggccatcgaggggctgactgtcaagtccggcgtcgacaaccccaacgccggccagtggcagaggagcaacgtcgtccccaaacccaccgccgtctacttcggctgggagtcgtacggcggcgacaccaacaccttctggtacgacgacatcgtcatcagcgacacccgcgtcgggtgcgagtaattaga

SEQ ID NO: 224 - protein, 236 aa, Chrysosporium lucknowense
MFRKTALLLLAALPFSFAQISEDFEGGWDESAWPIYANDCNQGGKVSLDTTTAHSGSNSVRVDGAGGYCGHIFFGTTSVPSGDLYVRTWLKAQNALTDAHVSFITMPDSAQGANKHLRIGGQSKILMYNRESDDATLPDLSPQGIAASKALPTGDWQCLEYHVGADGTIETWLNGEAIEGLTVKSGVDNPNAGQWQRSNVVPKPTAVYFGWESYGGDTNTFWYDDIVISDTRVGCE

SEQ ID NO: 225 - DNA, 708 bp, Chrysosporium lucknowense
atgttccgcaagaccgctcttctgctcctcgccgccctccccttctccttcgcgcagatctcggaggactttgaaggcggttgggacgagtcggcgtggccgatctacgccaacgactgcaaccagggcggcaaggtgtcgctggacaccaccactgcccacagcggctctaactcggtccgggttgacggcgccggtggttactgcgggcacattttctttggcacgacgtccgtccctagcggtgatctctatgtcaggacatggctgaaagcgcaaaacgccctcaccgacgcccacgttagcttcatcaccatgccggactcggcccagggggcgaacaagcacctccggatcggcgggcagagcaagatcctcatgtacaaccgcgagtcggacgacgcgacgctcccggacctgtcgccgcagggcatcgccgcgtcgaaggccctgcccacgggcgactggcagtgcctcgagtaccacgtcggcgccgacggcaccatcgagacgtggctcaacggcgaggccatcgaggggctgactgtcaagtccggcgtcgacaaccccaacgccggccagtggcagaggagcaacgtcgtccccaaacccaccgccgtctacttcggctgggagtcgtacggcggcgacaccaacaccttctggtacgacgacatcgtcatcagcgacacccgcgtcgggtgcgag

SEQ ID NO: 226 - DNA, 1275 bp, Chrysosporium lucknowense
  CDS (180)..(668)
  CDS (776)..(1225)
gtataattctacgtcatcccctccgttcccttcccagctcccctctcctactgctgagtgatgttaataatagtacgagtcgtggaatttgtggatactgatccaggataaagtctcttccattcggcccgacctcctaaaactcccgacaaagctaaaccgccccgtgtgacgacaagatgaagctcctgggcaaactctcggcggcactcgccctcgcgggcagcaggctggctgccgcgcacccggtcttcgacgagctgatgcggccgacggcgccgctggtgcgcccgcgggcggccctgcagcaggtgaccaactttggcagcaacccgtccaacacgaagatgttcatctacgtgcccgacaagctggcccccaacccgcccatcatagtggccatccactactgcaccggcaccgcccaggcctactactcgggctccccttacgcccgcctcgccgaccagaagggcttcatcgtcatctacccggagtccccctacagcggcacctgttgggacgtctcgtcgcgcgccgccctgacccacaacggcggcggcgacagcaactcgatcgccaacatggtcacctacaccctcgaaaagtacaatggcgacgccagcaaggtctttgtcaccggctcctcgtccggcgccatgatgacggtgcgttctaattacccctcccactccttttttttttttttttgttttccttccttttctttttcccaggagcgtcttggttgattgactgacttgttcaaatccagaacgtgatggccgccgcgtacccggaactgttcgcggcaggaatcgcctactcgggcgtgcccgccggctgcttctacagccagtccggaggcaccaacgcgaggaacagctcgtgcgccaacgggcagatcaactcgacgccccaggtgtgggccaagatggtcttcgacatgtacccggaatacgacggcccgcgccccaagatgcagatctaccacggctcggccgacggcacgctcagacccagcaactacaacgagaccatcaagcagtggtgcggcgtcttcggcttcgactacacccgccccgacaccacccaggccaactccccgcaggccggctacaccacctacacctggggcgagcagcagctcgtcggcatctacgcccagggcgtcggacacacggtccccatccgcggcagcgacgacatggccttctttggcctgtgatgatgagaggttcggtgggctgggaaccagagcggaagtacggttta

SEQ ID NO: 227 - protein, 313 aa, Chrysosporium lucknowense
MKLLGKLSAALALAGSRLAAAHPVFDELMRPTAPLVRPRAALQQVTNFGSNPSNTKMFIYVPDKLAPNPPIIVAIHYCTGTAQAYYSGSPYARLADQKGFIVIYPESPYSGTCWDVSSRAALTHNGGGDSNSIANMVTYTLEKYNGDASKVFVTGSSSGAMMTNVMAAAYPELFAAGIAYSGVPAGCFYSQSGGTNARNSSCANGQINSTPQVWAKMVFDMYPEYDGPRPKMQIYHGSADGTLRPSNYNETIKQWCGVFGFDYTRPDTTQANSPQAGYTTYTWGEQQLVGIYAQGVGHTVPIRGSDDMAFFGL

SEQ ID NO: 228 - DNA, 939 bp, Chrysosporium lucknowense
atgaagctcctgggcaaactctcggcggcactcgccctcgcgggcagcaggctggctgccgcgcacccggtcttcgacgagctgatgcggccgacggcgccgctggtgcgcccgcgggcggccctgcagcaggtgaccaactttggcagcaacccgtccaacacgaagatgttcatctacgtgcccgacaagctggcccccaacccgcccatcatagtggccatccactactgcaccggcaccgcccaggcctactactcgggctccccttacgcccgcctcgccgaccagaagggcttcatcgtcatctacccggagtccccctacagcggcacctgttgggacgtctcgtcgcgcgccgccctgacccacaacggcggcggcgacagcaactcgatcgccaacatggtcacctacaccctcgaaaagtacaatggcgacgccagcaaggtctttgtcaccggctcctcgtccggcgccatgatgacgaacgtgatggccgccgcgtacccggaactgttcgcggcaggaatcgcctactcgggcgtgcccgccggctgcttctacagccagtccggaggcaccaacgcgaggaacagctcgtgcgccaacgggcagatcaactcgacgccccaggtgtgggccaagatggtcttcgacatgtacccggaatacgacggcccgcgccccaagatgcagatctaccacggctcggccgacggcacgctcagacccagcaactacaacgagaccatcaagcagtggtgcggcgtcttcggcttcgactacacccgccccgacaccacccaggccaactccccgcaggccggctacaccacctacacctggggcgagcagcagctcgtcggcatctacgcccagggcgtcggacacacggtccccatccgcggcagcgacgacatggccttctttggcctg

SEQ ID NO: 229 - DNA, 1440 bp, Chrysosporium lucknowense
  CDS (282)..(402)
  CDS (470)..(594)
  CDS (672)..(929)
  CDS (987)..(1166)
cccaaagagattaaagcgaccttccggcgtgccattaggcagccttccgccgaccctttctccgtcttccctatttcgaacacccgtccgtccgggctccggggtgtaacatagggtctcggacgagggtcatcagacggtgtcgagtgatgctctggtttgtaatgtagttatataatataagaatccacccgactcttcggtgtacttgtagccgatgtttgatcagggcacatctcaagtccatctatactcttcaatcagaataacatatacacgccatgaaggtcaccgccgttgccgttcccgtcctggctggcattgccagcgccaaccccgtcgacgtcgaggcccgccagtcgtgccccgaggtccacgtattcggcgcccgggaaactacaggtaattaagcttagggttggggttgtctcaggggtaattacggctacctaactaacgtcaacatcagcaccccctggctatggcacatcccaaggcctcgtcaacatggtcgtgcaggcgtaccccggagcaacaagcgaggccataaactaccccgcatgcggcggtcaggcgtcttgcggtggaatcgatgcaagtgaccccgaaaatgccgctgactgtaaatcaggtgcatccgttgttcctaacgagtaactcggggcttttagtacaatacctctgcgaaccagggcactcaggcggttgtctccgctgtgacgagctttaaccagcgctgccctgacacaaagatcgtcttgatcggctattcgcagggtggccagatcatggacaacgcctactgcggcggcgccggtgccaccctcagcggcagcgccctcaacgccgttaaagccacggtctggttcggaaatccgcattatctgagccaattaagttatcgagttgggacatgccaggccggaggggtaggttcctctattgtcgatgtattttcgtgagacacgacatgctgaccgagatagttcgcggcccgccctcccggattccaatgttcgcctggtaacccagataacatcaagtcgtactgcgatgccgaggatccgtactgctgcaatggaaacgatgcaaaccaccaccaacagtacgtcaccatctacggccagcaggcgctcgccttcatcaagtcgaagctcgacgctgcttaagcgtagggagatacgctgcgttggaaagggggcgatggagcacattaccaagtaaatacagtgccacgtccgtttgtatgtacacaggtagccaaaaaaacagccatgctcggatccatatgtttgcccctctctcttggagtgacccgactctgttgaggttgttggtatcgcggtacgagaaagtggacgaccaaggcaccaatgagctgctgctctttgcaatggacatttctgggcgatatttgccgtgaactatcacactcgccat

SEQ ID NO: 230 - protein, 228 aa, Chrysosporium lucknowense
MKVTAVAVPVLAGIASANPVDVEARQSCPEVHVFGARETTAPPGYGTSQGLVNMVVQAYPGATSEAINYPACGGQASCGGIDYNTSANQGTQAVVSAVTSFNQRCPDTKIVLIGYSQGGQIMDNAYCGGAGATLSGSALNAVKATVWFGNPHYLSQLSYRVGTCQAGGFAARPPGFQCSPGNPDNIKSYCDAEDPYCCNGNDANHHQQYVTIYGQQALAFIKSKLDAA

SEQ ID NO: 231 - DNA, 684 bp, Chrysosporium lucknowense
atgaaggtcaccgccgttgccgttcccgtcctggctggcattgccagcgccaaccccgtcgacgtcgaggcccgccagtcgtgccccgaggtccacgtattcggcgcccgggaaactacagcaccccctggctatggcacatcccaaggcctcgtcaacatggtcgtgcaggcgtaccccggagcaacaagcgaggccataaactaccccgcatgcggcggtcaggcgtcttgcggtggaatcgattacaatacctctgcgaaccagggcactcaggcggttgtctccgctgtgacgagctttaaccagcgctgccctgacacaaagatcgtcttgatcggctattcgcagggtggccagatcatggacaacgcctactgcggcggcgccggtgccaccctcagcggcagcgccctcaacgccgttaaagccacggtctggttcggaaatccgcattatctgagccaattaagttatcgagttgggacatgccaggccggagggttcgcggcccgccctcccggattccaatgttcgcctggtaacccagataacatcaagtcgtactgcgatgccgaggatccgtactgctgcaatggaaacgatgcaaaccaccaccaacagtacgtcaccatctacggccagcaggcgctcgccttcatcaagtcgaagctcgacgctgct

SEQ ID NO: 232 - DNA, 2451 bp, Chrysosporium lucknowense
  CDS (57)..(1851)
  CDS (1954)..(2357)
aggaccgtcaaacgtaagggcagctctagctcaccagatacgagacgtcgcccatcatgacccttcaagcctttgcgctgctggcggcggcggcccttgtacggggcgagaccccgaccaaggtccctcgcgacgctccgagaggagctgctgcttgggaagctgcccactcctcagcagccgctgccttgggaaagctgtcccagcaggacaagatcaacatcgtgacgggcgtcggctggaacaaggggccctgcgtgggcaatactcccgctatcagctccatcaactacccgcagctctgcctccaagacggacccctgggcgtccgcttcggttccagcatcaccgctttcactccaggcattcaggccgcgtcgacgtgggatgtggacctgatccgacaacgaggcgagtacatgggcgccgagttcaaggggtgtggcatccacgtccagctaggccccgtggccgggcccttgggtaaggttccgcaaggcggccgcaactgggagggctttggcgtggatccctacctcaccggcattgccatggccgagaccatcgaggggatacagtcagcgggcgtgcaagccaccgccaagcattacatcctcaacgagcaggagctcaaccgcgagaccatgagcagcaatgtcgacgaccgcaccttgcacgagctgtacctctggccttttgcagacgctgttcactctaacgtggccagcgtcatgtgcagttacaacaagatcaacggcacgtgggcgtgcgagaacgaccgggtgctgaacgtcattctgaagcaggagcttgggtttccgggctatgtgatgagcgactggaacgcgcagcactcgaccgacgacgcggccaaccacggcatggacatgacgatgcccggcagcgacttcaacggagggacgatcctctggggcccgcagctcgacagcgccgtcaacagcggccgggtgcccaagtcccgcctcgacgacatggtcgagcgcatcctcgcggcgtggtaccttctcggtcaggacagcaattacccggctatcaacatcggcgccaacgtacagggcaaccacaaggagaacgtgcgggcggtcgcgcgcgatggcatcgtgctcctcaagaacgacgacggcatcctcccgctcaagaagcccgccaagctcgccctcatcggttcggccgccgtcgtcaacccgcagggactgaactcctgccaggatcagggctgcaacaaaggcgcgctgggcatgggatgggggtccggggcggtcaactacccgtactttgtcgcgccgtacgacgcgctcaaggcccgcgcccaagaggacgggacgacggtcagcctgcacaactcggacagcacgagcggggtggcgaacgtggcctcggacgcggacgcggccatcgtggtcatcacggccgactcgggcgagggttacatcacagtcgaaggcgccgccggggaccggctgaacctcgacccgtggcacaacggcaacgagctggtaaaggcggtggcggcggccaacaagaacaccatcgtcgtcgtgcacagcgtcgggcccatcatcctcgagaccatcctggcaaccgaaggggtcaaggcgattgtgtgggccggcctgccaagccaggagaatggtaacgcgctggtggacatcctgtacggtctggcctcgccgtcgggcaagctggtctacaccatcgccaagcgagaacaggactacggcactgcggtcgttcgcggagacgacacatttccggagggcctgtttgtcgactaccggcactttgacaaggagaacatcgagccgcggtacgagtttgggtttgggctgtgtaagttgttctctgtcataaagagtgtccccgtccactccgccatctttttttttttttcagttttacctcgtcctaacagcaagtgaaacaaactggcagcatacaccaacttcacgtacgccgacctcgaactcacctcgaccgccacggccggcccagcgacgggcgagaccatccccggcggcgcggccgacctctgggaggaggtggccacggtcacggcgaccatcaccaacagcggcggcgtggacggcgccgaggtggcccagctgtacctgacgttgccgtcgtcggcgccggcgaccccgcccaagcagctccgcggcttcgccaagctcaagctggcggccggcgccagcgggaccgcgacgtttagtctgcgcaggcgcgacctcagctactgggacaccggccgcgggcagtgggtggtgccggagggcgagtttggcgtctcggtcggggcgagctcgcgcgatatccggctgacggggagcttccgagtatgaaaggaaatatcctggggcggatagtttctgcttcttcgatggagtgaactatatataggtgcgcccggacgccagagatatggacaataac

SEQ ID NO: 233 - protein, 733 aa, Chrysosporium lucknowense
MTLQAFALLAAAALVRGETPTKVPRDAPRGAAAWEAAHSSAAAALGKLSQQDKINIVTGVGWNKGPCVGNTPAISSINYPQLCLQDGPLGVRFGSSITAFTPGIQAASTWDVDLIRQRGEYMGAEFKGCGIHVQLGPVAGPLGKVPQGGRNWEGFGVDPYLTGIAMAETIEGIQSAGVQATAKHYILNEQELNRETMSSNVDDRTLHELYLWPFADAVHSNVASVMCSYNKINGTWACENDRVLNVILKQELGFPGYVMSDWNAQHSTDDAANHGMDMTMPGSDFNGGTILWGPQLDSAVNSGRVPKSRLDDMVERILAAWYLLGQDSNYPAINIGANVQGNHKENVRAVARDGIVLLKNDDGILPLKKPAKLALIGSAAVVNPQGLNSCQDQGCNKGALGMGWGSGAVNYPYFVAPYDALKARAQEDGTTVSLHNSDSTSGVANVASDADAAIVVITADSGEGYITVEGAAGDRLNLDPWHNGNELVKAVAAANKNTIVVVHSVGPIILETILATEGVKAIVWAGLPSQENGNALVDILYGLASPSGKLVYTIAKREQDYGTAVVRGDDTFPEGLFVDYRHFDKENIEPRYEFGFGLSYTNFTYADLELTSTATAGPATGETIPGGAADLWEEVATVTATITNSGGVDGAEVAQLYLTLPSSAPATPPKQLRGFAKLKLAAGASGTATFSLRRRDLSYWDTGRGQWVVPEGEFGVSVGASSRDIRLTGSFRV

SEQ ID NO: 234 - DNA, 2199 bp, Chrysosporium lucknowense
atgacccttcaagcctttgcgctgctggcggcggcggcccttgtacggggcgagaccccgaccaaggtccctcgcgacgctccgagaggagctgctgcttgggaagctgcccactcctcagcagccgctgccttgggaaagctgtcccagcaggacaagatcaacatcgtgacgggcgtcggctggaacaaggggccctgcgtgggcaatactcccgctatcagctccatcaactacccgcagctctgcctccaagacggacccctgggcgtccgcttcggttccagcatcaccgctttcactccaggcattcaggccgcgtcgacgtgggatgtggacctgatccgacaacgaggcgagtacatgggcgccgagttcaaggggtgtggcatccacgtccagctaggccccgtggccgggcccttgggtaaggttccgcaaggcggccgcaactgggagggctttggcgtggatccctacctcaccggcattgccatggccgagaccatcgaggggatacagtcagcgggcgtgcaagccaccgccaagcattacatcctcaacgagcaggagctcaaccgcgagaccatgagcagcaatgtcgacgaccgcaccttgcacgagctgtacctctggccttttgcagacgctgttcactctaacgtggccagcgtcatgtgcagttacaacaagatcaacggcacgtgggcgtgcgagaacgaccgggtgctgaacgtcattctgaagcaggagcttgggtttccgggctatgtgatgagcgactggaacgcgcagcactcgaccgacgacgcggccaaccacggcatggacatgacgatgcccggcagcgacttcaacggagggacgatcctctggggcccgcagctcgacagcgccgtcaacagcggccgggtgcccaagtcccgcctcgacgacatggtcgagcgcatcctcgcggcgtggtaccttctcggtcaggacagcaattacccggctatcaacatcggcgccaacgtacagggcaaccacaaggagaacgtgcgggcggtcgcgcgcgatggcatcgtgctcctcaagaacgacgacggcatcctcccgctcaagaagcccgccaagctcgccctcatcggttcggccgccgtcgtcaacccgcagggactgaactcctgccaggatcagggctgcaacaaaggcgcgctgggcatgggatgggggtccggggcggtcaactacccgtactttgtcgcgccgtacgacgcgctcaaggcccgcgcccaagaggacgggacgacggtcagcctgcacaactcggacagcacgagcggggtggcgaacgtggcctcggacgcggacgcggccatcgtggtcatcacggccgactcgggcgagggttacatcacagtcgaaggcgccgccggggaccggctgaacctcgacccgtggcacaacggcaacgagctggtaaaggcggtggcggcggccaacaagaacaccatcgtcgtcgtgcacagcgtcgggcccatcatcctcgagaccatcctggcaaccgaaggggtcaaggcgattgtgtgggccggcctgccaagccaggagaatggtaacgcgctggtggacatcctgtacggtctggcctcgccgtcgggcaagctggtctacaccatcgccaagcgagaacaggactacggcactgcggtcgttcgcggagacgacacatttccggagggcctgtttgtcgactaccggcactttgacaaggagaacatcgagccgcggtacgagtttgggtttgggctgtcatacaccaacttcacgtacgccgacctcgaactcacctcgaccgccacggccggcccagcgacgggcgagaccatccccggcggcgcggccgacctctgggaggaggtggccacggtcacggcgaccatcaccaacagcggcggcgtggacggcgccgaggtggcccagctgtacctgacgttgccgtcgtcggcgccggcgaccccgcccaagcagctccgcggcttcgccaagctcaagctggcggccggcgccagcgggaccgcgacgtttagtctgcgcaggcgcgacctcagctactgggacaccggccgcgggcagtgggtggtgccggagggcgagtttggcgtctcggtcggggcgagctcgcgcgatatccggctgacggggagcttccgagta

What is claimed is:

1. An isolated protein comprising an amino acid sequence encoded by the nucleic acid molecule of SEQ ID NO 214 or SEQ ID NO: 216.

2. An isolated protein comprising an amino acid sequence encoded by SEQ ID NO 215.

3. An isolated fusion protein comprising the isolated protein of claim 1 fused to a protein comprising an amino acid sequence that is heterologous to the isolated protein of claim 1.

4. A kit for degrading a lignocellulosic material to fermentable sugars comprising at least one isolated protein of claim 1.

5. A detergent comprising at least one isolated protein of claim 1.

6. A composition for the degradation of a lignocellulosic material comprising at least one isolated protein of claim 1.

7. A recombinant enzyme isolated from a genetically modified microorganism comprising components suitable for degrading a lignocellulosic material to fermentable sugars, wherein the organism has been genetically modified to express at least one protein of claim 1.

8. The recombinant enzyme of claim 7, wherein the enzyme has been subjected to a purification step.

9. A crude fermentation product produced by culturing the cells from a genetically modified organism comprising components suitable for degrading a lignocellulosic material to fermentable sugars, wherein the crude fermentation product contains at least one protein of claim 1.

10. A detergent composition, comprising at least one isolated protein of claim 1 and at least one surfactant.

11. A composition for degrading cell walls comprising at least one isolated protein of claim 1.

* * * * *